(12) United States Patent
Ørntoft et al.

(10) Patent No.: US 10,106,854 B2
(45) Date of Patent: Oct. 23, 2018

(54) BIOMARKERS FOR PROSTATE CANCER

(71) Applicants: Aarhus Universitet, Århus C (DK); Region Midtjylland, Viborg (DK)

(72) Inventors: Torben Falck Ørntoft, Silkeborg (DK); Karina Dalsgaard Sørensen, Århus C (DK); Christa Haldrup, Nørre Snede (DK)

(73) Assignees: Aarhus Universitet, Århus (DK); Region Midtjylland, Viborg (DK)

( * ) Notice: Subject to any disclaimer, the term of this patent is extended or adjusted under 35 U.S.C. 154(b) by 118 days.

(21) Appl. No.: 14/407,541

(22) PCT Filed: Jun. 14, 2013

(86) PCT No.: PCT/DK2013/050196
§ 371 (c)(1),
(2) Date: Dec. 12, 2014

(87) PCT Pub. No.: WO2013/185779
PCT Pub. Date: Dec. 19, 2013

(65) Prior Publication Data
US 2015/0152507 A1    Jun. 4, 2015

(30) Foreign Application Priority Data

Jun. 14, 2012 (DK) .......................... PA 2012 70326

(51) Int. Cl.
| | | |
|---|---|---|
| *C12Q 1/68* | (2018.01) | |
| *C07H 21/04* | (2006.01) | |
| *C12Q 1/6886* | (2018.01) | |
| *G16H 50/30* | (2018.01) | |

(52) U.S. Cl.
CPC ........... *C12Q 1/6886* (2013.01); *G16H 50/30* (2018.01); *C12Q 2600/106* (2013.01); *C12Q 2600/118* (2013.01); *C12Q 2600/154* (2013.01)

(58) Field of Classification Search
None
See application file for complete search history.

(56) References Cited

U.S. PATENT DOCUMENTS

| | | | |
|---|---|---|---|
| 5,786,146 A | 7/1998 | Herman et al. | |
| 6,605,432 B1 | 8/2003 | Huang | |
| 2010/0303795 A1* | 12/2010 | Sorensen | A61K 31/192 424/94.6 |
| 2014/0094380 A1* | 4/2014 | Sherlock | C12Q 1/6886 506/9 |

FOREIGN PATENT DOCUMENTS

| | | |
|---|---|---|
| WO | WO-02/070742 A1 | 9/2002 |
| WO | WO-2008/143896 A1 | 11/2008 |
| WO | WO-2010/017301 A1 | 2/2010 |
| WO | WO-2010/080933 A1 | 7/2010 |
| WO | WO-2011/037936 A2 | 3/2011 |
| WO | WO-2011/044902 A1 | 4/2011 |

OTHER PUBLICATIONS

Kobayashi et al. (DNA Methylation profiling reveals Novel Biomarkers and Important Roles for DNA Methyltransferases in Prostate Cancer, A Dissertation submitted to the Dept of Genetics and the Committee on Graduate Studies of Stanfor University, Feb. 2011).*
Feng (PNAS 2010 vol. 107 No. 19 pp. 8689-8694).*
Toyota et al. Cancer Research, vol. 59, pp. 4535-4541, Sep. 1999.*
Pao et al. (Human Molecular Genetics, vol. 10, No. 9, pp. 903-910).*
Cameron et al. (Blood, vol. 94, No. 7, pp. 2445-2451, Oct. 1999).*
Dedeurwaerder et al. (Epigenomics, vol. 3, No. 6, pp. 771, 784, Nov. 2011). (Year: 2011).*
Abildgaard et al., "Downregulation of zinc finger protein 132 in prostate cancer is associated with aberrant promoter hypermethylation and poor prognosis," Int J Cancer. 130(4):885-95 (2012).
Cedar, "DNA methylation and gene activity," Cell. 53(1):3-4 (1988).
Florl et al., "Coordinate hypermethylation at specific genes in prostate carcinoma precedes LINE-1 hypomethylation," Br J Cancer. 91(5):985-94 (2004).
Galm et al., "Enzymatic regional methylation assay: a novel method to quantify regional CpG methylation density," Genome Res. 12(1):153-7 (2002).
Hochberg, "A sharper Bonferroni procedure for multiple tests of significance," Biometrika. 75(4):800-2 (1988).
Humphrey, "Gleason grading and prognostic factors in carcinoma of the prostate," Mod Pathol. 17(3):292-306 (2004).
Jerónimo et al., "Quantitation of GSTP1 methylation in non-neoplastic prostatic tissue and organ-confined prostate adenocarcinoma," J Natl Cancer Inst. 93(22):1747-52 (2001).
Kumaki et al., "QUMA: quantification tool for methylation analysis," Nucleic Acids Res. 36:W170-5 (2008).
Li et al., "MethPrimer: designing primers for methylation PCRs," Bioinformatics. 18(11):1427-31 (2002).
Mardis, "The impact of next-generation sequencing technology on genetics," Trends Genet. 24(3):133-41 (2008).
Oster et al., "Identification and validation of highly frequent CpG island hypermethylation in colorectal adenomas and carcinomas," Int J Cancer. 129(12):2855-66 (2011).

(Continued)

*Primary Examiner* — Jeanine A Goldberg
(74) *Attorney, Agent, or Firm* — Clark & Elbing LLP

(57) ABSTRACT

The present application concerns methods and tools for diagnosing prostate cancer and furthermore concerns methods and tools for prognosing disease progression of prostate cancer. The method comprises determining methylation level of the genes C1orf114, HAPLN3, AOX1, GAS6, ST6GALNAC3 and ZNF660 and comparing the result with a control, thus obtaining a response which is used for diagnosing a prostate cancer and/or for prognosing aspects of an individual suffering from prostate cancer.

21 Claims, 23 Drawing Sheets
Specification includes a Sequence Listing.

(56) References Cited

OTHER PUBLICATIONS

Prensner et al., "Beyond PSA: the next generation of prostate cancer biomarkers," Sci Transl Med. 4(127):127rv3 (2012) (23 pages).
Rozen et al., "Primer3 on the WWW for general users and for biologist programmers," Methods Mol Biol. 132:365-86 (2000).
Schulz et al., "Factor interaction analysis for chromosome 8 and DNA methylation alterations highlights innate immune response suppression and cytoskeletal changes in prostate cancer," Mol Cancer. 6:14 (2007) (16 pages).
Sørensen et al., "Genetic and epigenetic SLC18A2 silencing in prostate cancer is an independent adverse predictor of biochemical recurrence after radical prostatectomy," Clin Cancer Res. 15(4):1400-10 (2009).
Soørensen et al., "Prognostic significance of aberrantly silenced ANPEP expression in prostate cancer," Br J Cancer. 108(2):420-8 (2013).
Tost et al., "DNA methylation analysis by pyrosequencing," Nat Protoc. 2(9):2265-75 (2007).
Varambally et al., "Integrative genomic and proteomic analysis of prostate cancer reveals signatures of metastatic progression," Cancer Cell. 8(5):393-406 (2005).
Vestergaard et al., "Promoter hypomethylation and upregulation of trefoil factors in prostate cancer," Int J Cancer. 127(8):1857-65 (2010).
Wojdacz et al., "Methylation-sensitive high-resolution melting," Nat Protoc. 3(12):1903-8 (2008).
Yamashita et al., "Methylation silencing of transforming growth factor-beta receptor type II in rat prostate cancers," Cancer Res. 68(7):2112-21 (2008).
Zhang et al., "Genome-wide study of DNA methylation alterations in response to diazinon exposure in vitro," Environ Toxicol Pharmacol. 34(3):959-68 (2012).
International Search Report and Written Opinion of the International Searching Authority for International Application No. PCT/DK2013/050196, dated Dec. 5, 2013 (18 pages).
Conference Program for Gordon Research Conferences: Cancer Genetics and Epigenetics, Jan. 23-28, Ventura, CA. (2011) (29 pages).
Haldrup et al., "Identification of Novel Methylation Markers for Prostate Cancer," Gordon Research Conferences: Cancer Genetics and Epigenetics, Jan. 23-28, Ventura, CA. (2011) (Abstract Only) (1 page).
Haldrup et al., "Identification of Novel Methylation Markers for Prostate Cancer ," Gordon Research Conferences: Cancer Genetics and Epigenetics, Jan. 23-28, Ventura, CA. (2011) (Poster) (1 page).
Haldrup et al., "A three-gene DNA methylation signature for prediction of biochemical recurrence after radical prostatectomy of clinically localized prostate cancer," American Association for Cancer Research Annual Meeting, Apr. 6-10, Washington, D.C. (2013) (Abstract Only) (1 page).
Haldrup et al., "A three-gene DNA methylation signature for prediction of biochemical recurrence after radical prostatectomy of clinically localized prostate cancer," American Association for Cancer Research Annual Meeting, Apr. 6-10, Washington, D.C. (2013) (Poster) (1 page).
Haldrup et al., "DNA methylation signatures for prediction of biochemical recurrence after radical prostatectomy of clinically localized prostate cancer," J Clin Oncol. 31(26):3250-8 (2013) (10 pages).

\* cited by examiner

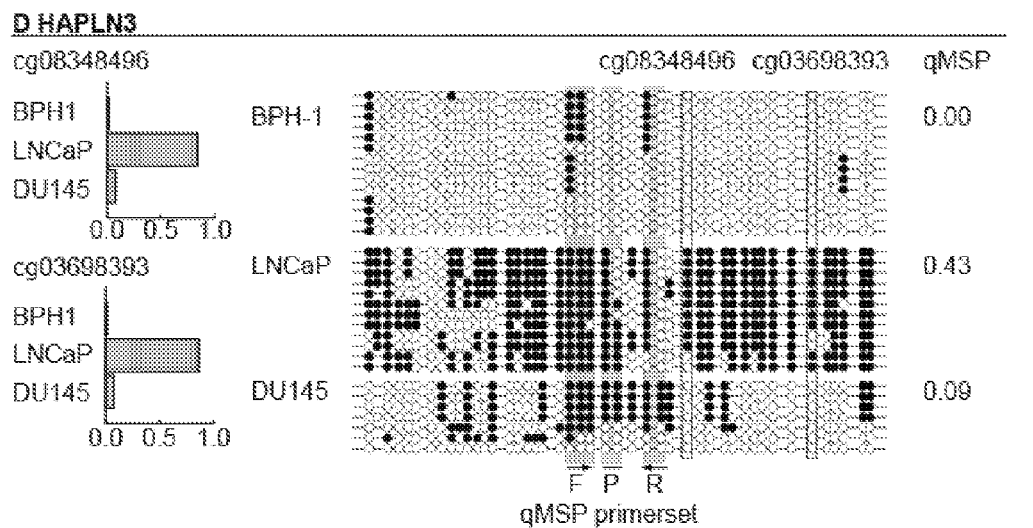
Fig. 5, cont.

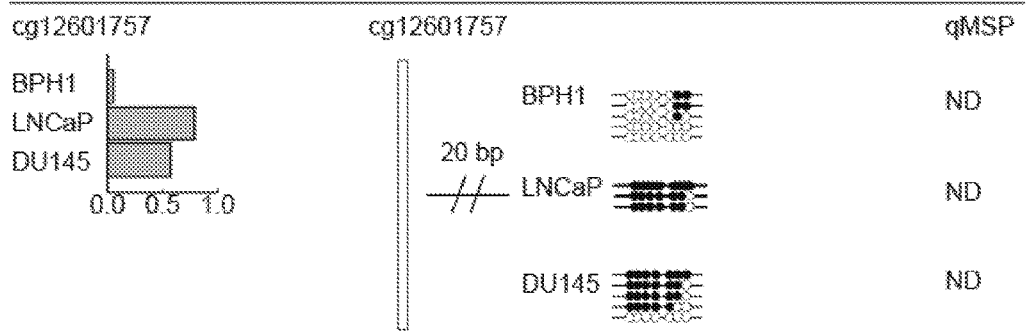
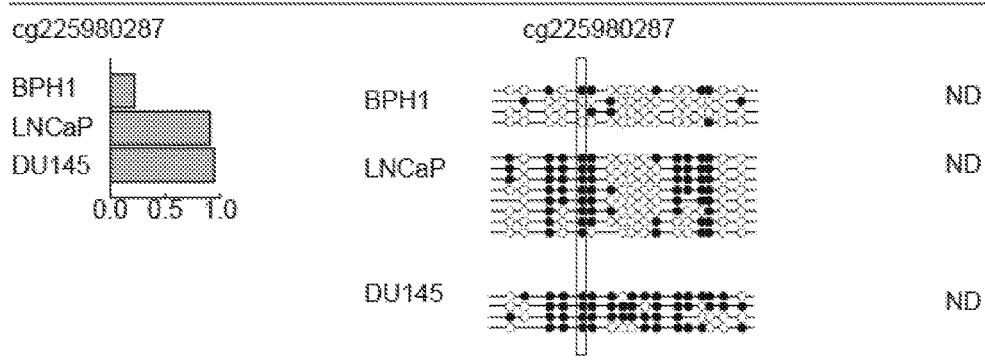
Fig. 5, cont.

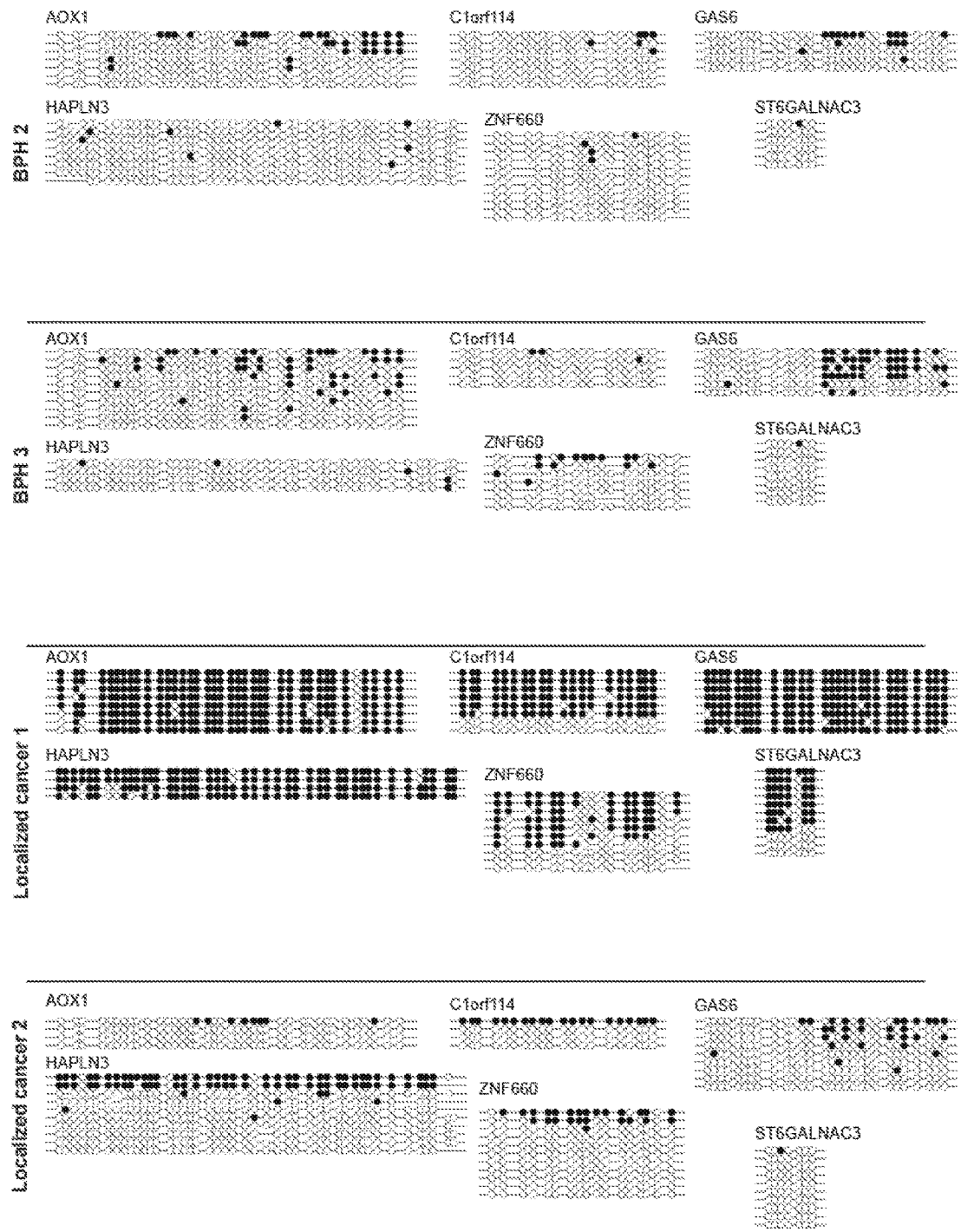
Fig. 6, cont.

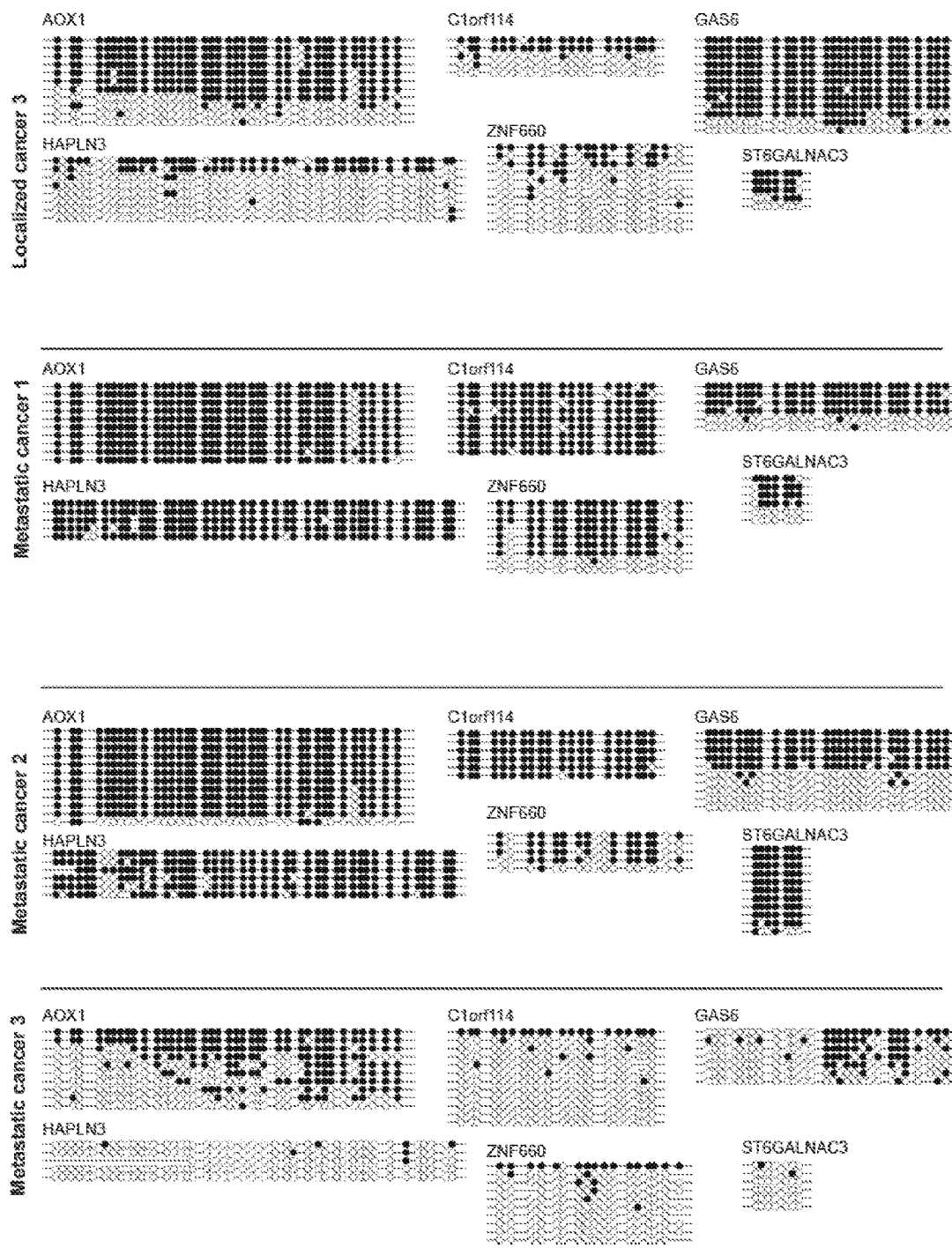
Fig. 6, cont.

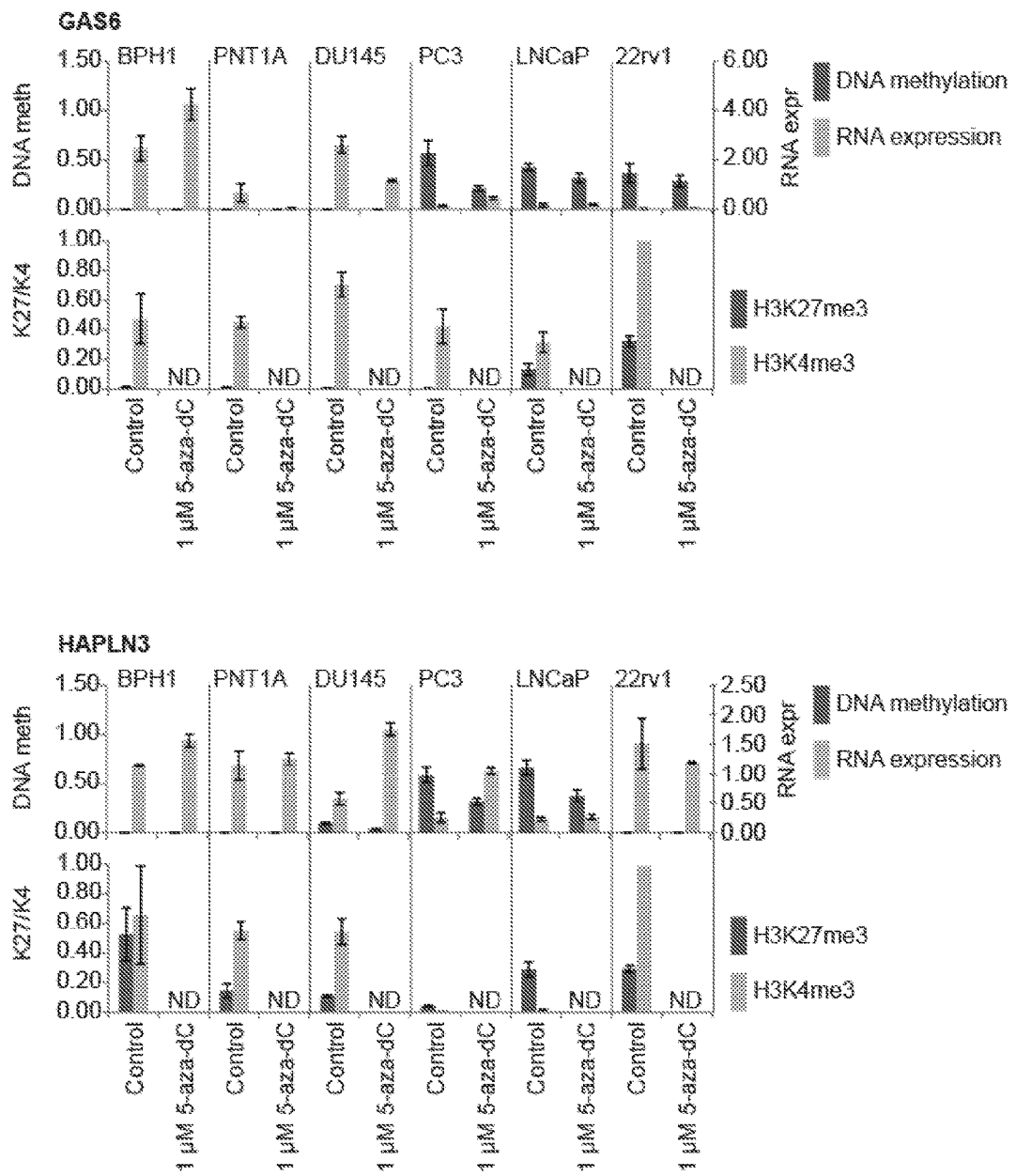
Fig. 10, cont.

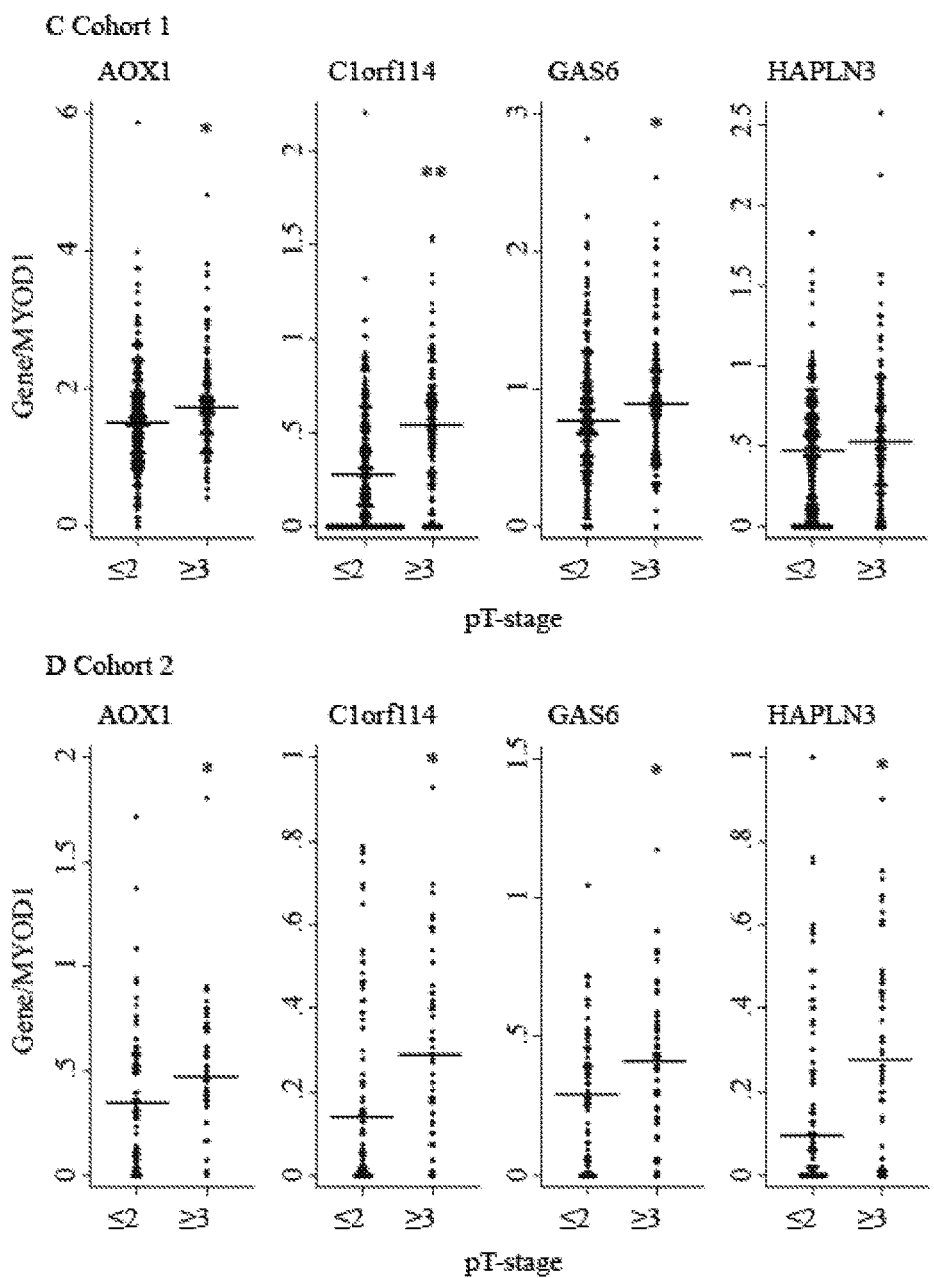
Fig. 11, cont.

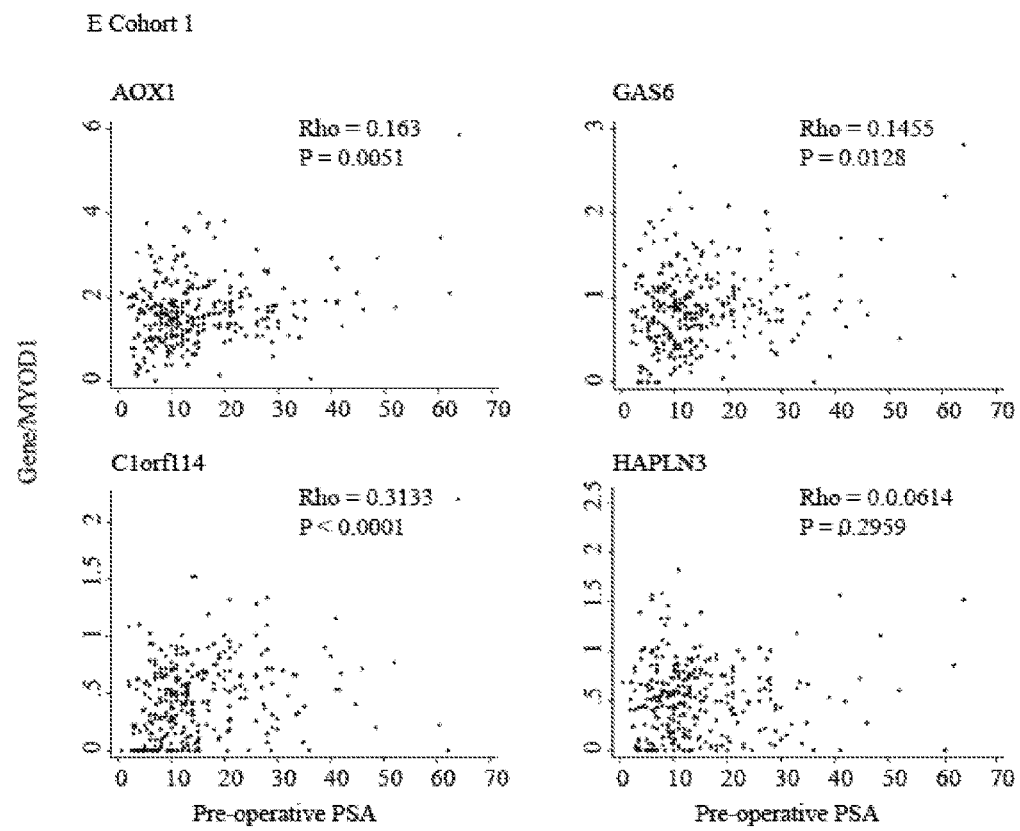
Fig. 11, cont.

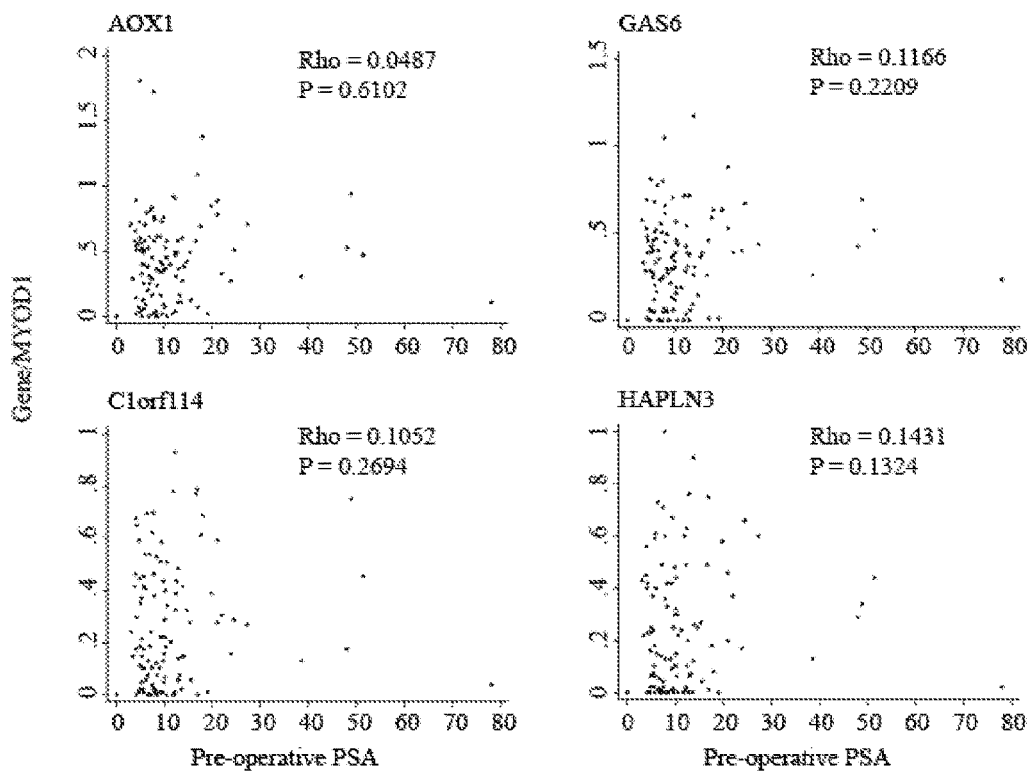
Fig. 11, cont.

FIG. 13A

| Patient | | AOX1 | C1orf114 | GAS6 | HAPLN3 | KLF8 | MOBKL2B | ST6GALNAC3 | ZNF660 |
|---|---|---|---|---|---|---|---|---|---|
| ADJ-N 1 | % meth all seq | 3.9 | 0.7 | 5.4 | 2.3 | 3 | 2.9 | 2.2 | 4.4 |
| | % meth most meth seq | 13 | 5 | 15 | 6.7 | 16 | 6.7 | 14 | 24 |
| ADJ-N 2 | % meth all seq | 7.5 | 2.6 | 3.3 | 0 | 10 | 1.7 | 13 | 6.8 |
| | % meth most meth seq | 45 | 5 | 15 | 8.9 | 53 | 3.3 | 86 | 12 |
| ADJ-N 3 | % meth all seq | 9.3 | 1.3 | 2.6 | 3.4 | 1.4 | 2.9 | 7.9 | 2.9 |
| | % meth most meth seq | 29 | 10 | 15 | 6.7 | 5.3 | 6.7 | 57 | 5.9 |
| ADJ-N 4 | % meth all seq | 6.6 | 2.5 | 6.2 | 4.5 | 3.3 | 1.7 | 3.6 | 3.1 |
| | % meth most meth seq | 21 | 10 | 23 | 16 | 16 | 6.7 | 14 | 12 |
| ADJ-N 5 | % meth all seq | 5.9 | 3.1 | 2.3 | 4 | 69 | 2.5 | 7.1 | 5.1 |
| | % meth most meth seq | 24 | 15 | 7.7 | 11 | 32 | 6.7 | 14 | 12 |
| BPH 1 | % meth all seq | 5.3 | 1.3 | 5.7 | 4.9 | 5.3 | 3.6 | 3.6 | 20 |
| | % meth most meth seq | 11 | 5 | 7.7 | 4.4 | 11 | 6.7 | 29 | 88 |
| BPH 2 | % meth all seq | 11 | 1 | 5.8 | 2.7 | 0 | 3.3 | 1.3 | 4.7 |
| | % meth most meth seq | 42 | 10 | 15 | 8.9 | 0 | 10 | 14 | 12 |
| BPH 3 | % meth all seq | 13 | 3 | 1.3 | 2.8 | 2 | 1.8 | 1.8 | 13 |
| | % meth most meth seq | 37 | 10 | 7.7 | 4.4 | 16 | 6.7 | 14 | 47 |
| BPH 4 | % meth all seq | 9.5 | 2 | 3.3 | 1.5 | 0 | 3.4 | 5.4 | 13 |
| | % meth most meth seq | 37 | 10 | 15 | 4.4 | 0 | 13 | 14 | 35 |
| BPH 5 | % meth all seq | 3.5 | 1.7 | 0 | 1.4 | 0 | 3.4 | nd | 0 |
| | % meth most meth seq | 7.9 | 5 | 0 | 2.2 | 0 | 6.7 | nd | 0 |
| BPH 6 | % meth all seq | 13 | 4.5 | 1.5 | 2.3 | 2.7 | 2.7 | 2.4 | 2.2 |
| | % meth most meth seq | 42 | 15 | 7.7 | 4.4 | 16 | 6.7 | 14 | 5.9 |

FIG. 13B

| Patient | | AOX1 | C1orf114 | GAS6 | HAPLN3 | KLF8 | MOBKL2B | ST6GALNAC3 | ZNF660 |
|---|---|---|---|---|---|---|---|---|---|
| RP 1 | % meth all seq | 93 | 73 | 97 | 92 | 79 | 98 | 58 | 44 |
|  | % meth most meth seq | 97 | 100 | 100 | 96 | 79 | 100 | 100 | 77 |
| RP 2 | % meth all seq | 98 | 0.7 | 30 | 30 | 1.4 | 69 | 27 | 63 |
|  | % meth most meth seq | 100 | 100 | 100 | 8.9 | 53 | 100 | 100 | 10 0 |
| RP 3 | % meth all seq | 12 | 62 | 31 | 10 | 24 | 33 | 11 | 9.8 |
|  | % meth most meth seq | 76 | 100 | 100 | 93 | 74 | 100 | 71 | 53 |
| RP 4 | % meth all seq | 23 | 14 | 0 | nd | 55 | 65 | nd | 4.3 |
|  | % meth most meth seq | 95 | 100 | 0 | nd | 95 | 100 | nd | 24 |
| RP 5 | % meth all seq | 5.3 | 25 | 13 | 18 | 21 | 77 | 1.4 | 13 |
|  | % meth most meth seq | 21 | 100 | 100 | 7.5 | 79 | 100 | 14 | 82 |
| RP 6 | % meth all seq | 76 | 60 | 68 | 40 | 46 | 78 | 21 | 2.4 |
|  | % meth most meth seq | 100 | 100 | 100 | 96 | 100 | 100 | 86 | 12 |
| RP 7 | % meth all seq | 60 | 84 | 73 | nd | 43 | 89 | 94 | 2 |
|  | % meth most meth seq | 97 | 100 | 100 | nd | 79 | 100 | 100 | 12 |
| RP 8 | % meth all seq | 28 | 58 | 47 | 1.7 | 22 | 44 | nd | 5.4 |
|  | % meth most meth seq | 76 | 100 | 100 | 4.4 | 79 | 100 | nd | 29 |
| RP 9 | % meth all seq | 69 | 47 | 82 | 23 | 32 | 5.3 | 66 | 25 |
|  | % meth most meth seq | 100 | 100 | 100 | 13 | 79 | 10 | 100 | 77 |
| RP 10 | % meth all seq | 41 | 23 | 33 | 2.3 | 16 | 44 | 3.9 | 40 |
|  | % meth most meth seq | 97 | 95 | 100 | 16 | 95 | 100 | 43 | 88 |

FIG. 13C

| Patient | | AOX1 | C1orf114 | GAS6 | HAPLN3 | KLF8 | MOBKL2B | ST6GALNAC3 | ZNF660 |
|---|---|---|---|---|---|---|---|---|---|
| MPC 1 | % meth all seq | 95 | 99 | 65 | 68 | 58 | 72 | 25 | 72 |
| | % meth most meth seq | 97 | 100 | 100 | 96 | 90 | 100 | 100 | 100 |
| MPC 2 | % meth all seq | 42 | 13 | 37 | 11 | 53 | 75 | 9.9 | 37 |
| | % meth most meth seq | 100 | 95 | 100 | 33 | 84 | 100 | 100 | 88 |
| MPC 3 | % meth all seq | 95 | 90 | 78 | 64 | 49 | 90 | 96 | 55 |
| | % meth most meth seq | 97 | 100 | 100 | 89 | 84 | 97 | 100 | 71 |
| MPC 4 | % meth all seq | 35 | 6.8 | 11 | 1.1 | 0 | 1.8 | 0 | 13 |
| | % meth most meth seq | 84 | 50 | 31 | 4.4 | 0 | 3.3 | 0 | 59 |
| MPC 5 | % meth all seq | 92 | 98 | 51 | 90 | 78 | 98 | 94 | 69 |
| | % meth most meth seq | 100 | 100 | 100 | 96 | 95 | 100 | 100 | 77 |
| MPC 6 | % meth all seq | 95 | 99 | 4.3 | 90 | 90 | 90 | 92 | 33 |
| | % meth most meth seq | 97 | 100 | 15 | 96 | 100 | 100 | 100 | 77 |
| MPC 7 | % meth all seq | 87 | 91 | 62 | 51 | 74 | 74 | 83 | 49 |
| | % meth most meth seq | 97 | 100 | 100 | 89 | 100 | 6.7 | 100 | 94 |
| MPC 8 | % meth all seq | 51 | 13 | 5.5 | 3.4 | 1.4 | 17 | 4.8 | 15 |
| | % meth most meth seq | 100 | 100 | 31 | 8.9 | 5.3 | 100 | 14 | 94 |
| MPC 9 | % meth all seq | 74 | 67 | 37 | 73 | 12 | 77 | 31 | 22 |
| | % meth most meth seq | 97 | 100 | 100 | 87 | 58 | 100 | 100 | 53 |
| MPC 10 | % meth all seq | 98 | 96 | 65 | 97 | 84 | 99 | 56 | 68 |
| | % meth most meth seq | 100 | 100 | 100 | 100 | 100 | 100 | 86 | 94 |

BIOMARKERS FOR PROSTATE CANCER

FIELD OF INVENTION

The present invention relates to a method for diagnosing prostate cancer in an individual, prognosing the disease progression of prostate cancer in an individual having developed prostate cancer, predicting the outcome of prostate cancer in an individual having developed prostate cancer, monitoring the effect of treatment on prostate cancer progression in an individual having developed prostate cancer, monitoring the progression of prostate cancer from a silent/indolent to an aggressive prostate cancer in an individual having developed prostate cancer and determining the treatment regime of an individual having developed prostate cancer.

BACKGROUND OF INVENTION

Prostate cancer (PC) is the most frequently diagnosed male cancer and the second leading cause of cancer-associated mortality in Western countries. PC is typically diagnosed on the basis of increased serum prostate specific antigen (PSA) levels followed by histopathological inspection of needle biopsies. The use of PSA for PC detection, however, is associated with considerable false positive rates and does not distinguish well between indolent and aggressive tumours. During the past decades, increased use of PSA testing and PSA based screening has resulted in higher incidences as well as down-staging of the disease. Combined with the lack of accurate prognostic tools, this has caused substantial overdiagnosis and overtreatment of clinically insignificant PCs. Thus, although some PC patients benefit from radical prostatectomy, conservative management (active surveillance or watchful waiting) is the preferred option for some patients with low or intermediate risk PC. Up to a third of patients undergoing radical prostatectomy suffers disease recurrence (biochemical relapse) within 5-10 years and eventually develops distant metastases. Progression to metastatic disease can be delayed by androgen deprivation therapy, but most tumours become resistant within two years and advance to castrate-refractory prostate cancer (CRPC) associated with high morbidity and mortality.

Methylation of DNA is a mechanism for changing the base sequence of DNA without altering its coding function. DNA methylation is a heritable, reversible and epigenetic change. DNA methylation harbours the potential to alter gene expression which in turn affects developmental and genetic processes.

CpG-rich sequences are known as CpG islands. CpG islands are distributed across the human genome and often span the promoter region as well as the first 5' exon of protein coding genes. Methylation of individual promoter region CpG islands usually turns off transcription by recruiting histone deacetylases, which supports the formation of inactive chromatin (Humphrey P A et al.: Mod Pathol 2004; 17: 292-306). CpG islands are typically between 0.2 to about 1 kb in length and are located upstream of many housekeeping and tissue-specific genes, but may also extend into gene coding regions. Therefore, it is the methylation of cytosine residues within CpG islands in somatic tissues, which is believed to affect gene function by altering transcription (Cedar, Cell 53:3-4, 1988).

SUMMARY OF INVENTION

As the prostate specific antigen (PSA) method is associated with considerable false negative rates and does not distinguish well between clinically indolent or aggressive tumours, there is a need for novel markers of prostate cancer that can be used on their own or in combination with existing markers.

The present inventors have found that the AOX1, C1orf114, GAS6, HAPLN3, ST6GALNAC3 and ZNF660 genes are associated with prostate cancer. Each of the genes can be used individually as an independent marker of prostate cancer; but they may also be used in combination with one another or with previously known prostate markers.

In one aspect, the invention thus concerns a method of determining if an individual has, or is at risk of developing prostate cancer, the method comprising the steps of:
  a) providing a sample obtained from said individual;
  b) determining in the sample of a),
    the methylation level, and/or
    the transcriptional expression level, and/or
    the translational expression level,
    of a panel of nucleotide sequences, wherein the panel comprises:
    I') the nucleotide sequence of SEQ ID NO:3 (GAS6); or
    I") a nucleotide sequence being complementary to SEQ ID NO: 3; or
    I'") a nucleotide sequence having at least 90% sequence identity to any one of I' or I"; or
    I"") a fragment of any one of I', I" or I'", wherein the fragment comprises at least 15 consecutive nucleotides of any one of I', I" or I'"; and
    II') the nucleotide sequence of SEQ ID NO:4 (HAPLN3); or
    II") a nucleotide sequence being complementary to SEQ ID NO: 4; or
    II'") a nucleotide sequence having at least 90% sequence identity to any one of II' or II"; or
    II"") a fragment of any one of II', II" or II'", wherein the fragment comprises at least 15 consecutive nucleotides of any one of I', I" or I'"; and
    III') the nucleotide sequence of SEQ ID NO:1 (AOX1); or
    III") a nucleotide sequence being complementary to SEQ ID NO: 1; or
    III'") a nucleotide sequence having at least 90% sequence identity to any one of III' or III"; or
    III"") a fragment of any one of III', III" or III'", wherein the fragment comprises at least 15 consecutive nucleotides of any one of III', III" or III'"; and
    IV') the nucleotide sequence of SEQ ID NO:2 (C1orf114); or
    IV") a nucleotide sequence being complementary to SEQ ID NO: 2; or
    IV'") a nucleotide sequence having at least 90% sequence identity to any one of IV' or IV"; or
    IV"") a fragment of any one of IV', IV" or IV'", wherein the fragment comprises at least 15 consecutive nucleotides of any one of IV', IV" or IV'"; and
    V') the nucleotide sequence of SEQ ID NO:5 (ST6GALNAC3); or
    V") a nucleotide sequence being complementary to SEQ ID NO: 5; or
    V'") a nucleotide sequence having at least 90% sequence identity to any one of V' or V"; or
    V"") a fragment of any one of V', V" or V'", wherein the fragment comprises at least 15 consecutive nucleotides of any one of V', V" or V'"; and VI') the nucleotide sequence of SEQ ID NO:6 (ZNF660); or VI") a nucleotide sequence being complementary to SEQ ID NO: 6; or VI''') a nucleotide sequence having at least 90% sequence identity to any one of VI' or VI'''; or VI'''') a fragment of any one of VI', VI" or VI''', wherein the fragment comprises at least 15 consecutive nucleotides of any one of VI', VI" or VI''';

c) comparing the methylation level, transcriptional level, and/or translational expression level of the sampled nucleotide sequence of b), with the corresponding methylation level, transcriptional level, and/or translational expression level of a corresponding nucleotide sequence of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

The six genes identified by the present inventors as relevant for prostate cancer, may be arranged in panels and optimised for e.g. diagnostic or prognostic purposes. Thus in one aspect, the invention concerns a method of determining if an individual has, or is at risk of developing prostate cancer, the method comprising the steps of:

a) providing a sample obtained from said individual;
b) determining in the sample of a),
   the methylation level, and/or
   the transcriptional expression level, and/or
   the translational expression level,
   of a panel comprising at least two nucleotide sequences, wherein the panel is selected from the group consisting of:

i) C1orf114 (SEQ ID NO:2) and GAS6 (SEQ ID NO:3);
ii) GAS6 (SEQ ID NO:3) and HAPLN3 (SEQ ID NO:4);
iii) C1orf114 (SEQ ID NO:2), GAS6 (SEQ ID NO:3) and HAPLN3 (SEQ ID NO:4);
iv) AOX1 (SEQ ID NO:1), C1orf114 (SEQ ID NO:2), GAS6 (SEQ ID NO:3) and HAPLN3 (SEQ ID NO:4);
v) AOX1 (SEQ ID NO:1), GAS6 (SEQ ID NO:3) and HAPLN3 (SEQ ID NO:4);
vi) AOX1 (SEQ ID NO:1), C1orf114 (SEQ ID NO:2) and GAS6 (SEQ ID NO:3);
vii) AOX1 (SEQ ID NO:1) and GAS6 (SEQ ID NO:3);
viii) C1orf114 (SEQ ID NO:2) and HAPLN3 (SEQ ID NO:4);
ix) AOX1 (SEQ ID NO:1), C1orf114 (SEQ ID NO:2) and HAPLN3 (SEQ ID NO:4);
x) AOX1 (SEQ ID NO:1) and HAPLN3 (SEQ ID NO:4);
xi) AOX1 (SEQ ID NO:1) and C1orf114 (SEQ ID NO:2);
xii) AOX1 (SEQ ID NO:1) and ST6GALNAC3 (SEQ ID NO:5);
xiii) AOX1 (SEQ ID NO:1) and ZNF660 (SEQ ID NO:6);
xiv) C1orf114 (SEQ ID NO:2) and ST6GALNAC3 (SEQ ID NO:5);
xv) C1orf114 (SEQ ID NO:2) and ZNF660 (SEQ ID NO:6);
xvi) GAS6 (SEQ ID NO:3) and ST6GALNAC3 (SEQ ID NO:5);
xvii) GAS6 (SEQ ID NO:3) and ZNF660 (SEQ ID NO:6);
xviii) HAPLN3 (SEQ ID NO:4) and ST6GALNAC3 (SEQ ID NO:5);
xix) HAPLN3 (SEQ ID NO:4) and ZNF660 (SEQ ID NO:6);
xx) ST6GALNAC3 (SEQ ID NO:5) and ZNF660 (SEQ ID NO:6);
xxi) AOX1 (SEQ ID NO:1), C1orf114 (SEQ ID NO:2) and ST6GALNAC3 (SEQ ID NO:5);
xxii) AOX1 (SEQ ID NO:1), C1orf114 (SEQ ID NO:2) and ZNF660 (SEQ ID NO:6);
xxiii) AOX1 (SEQ ID NO:1), GAS6 (SEQ ID NO:3) and ST6GALNAC3 (SEQ ID NO:5);
xxiv) AOX1 (SEQ ID NO:1), GAS6 (SEQ ID NO:3) and ZNF660 (SEQ ID NO:6);
xxv) AOX1 (SEQ ID NO:1), HAPLN3 (SEQ ID NO:4) and ST6GALNAC3 (SEQ ID NO:5);
xxvi) AOX1 (SEQ ID NO:1), HAPLN3 (SEQ ID NO:4) and ZNF660 (SEQ ID NO:6);
xxvii) AOX1 (SEQ ID NO:1), ST6GALNAC3 (SEQ ID NO:5) and ZNF660 (SEQ ID NO:6);
xxviii) C1orf114 (SEQ ID NO:2), GAS6 (SEQ ID NO:3) and ST6GALNAC3 (SEQ ID NO:5);
xxix) C1orf114 (SEQ ID NO:2), GAS6 (SEQ ID NO:3) and ZNF660 (SEQ ID NO:6);
xxx) C1orf114 (SEQ ID NO:2), HAPLN3 (SEQ ID NO:4) and ST6GALNAC3 (SEQ ID NO:5);
xxxi) C1orf114 (SEQ ID NO:2), HAPLN3 (SEQ ID NO:4) and ZNF660 (SEQ ID NO:6);
xxxii) C1orf114 (SEQ ID NO:2), ST6GALNAC3 (SEQ ID NO:5) and ZNF660 (SEQ ID NO:6);
xxxiii) GAS6 (SEQ ID NO:3), HAPLN3 (SEQ ID NO:4) and ST6GALNAC3 (SEQ ID NO:5);
xxxiv) GAS6 (SEQ ID NO:3), HAPLN3 (SEQ ID NO:4) and ZNF660 (SEQ ID NO:6);
xxxv) GAS6 (SEQ ID NO:3), ST6GALNAC3 (SEQ ID NO:5) and ZNF660 (SEQ ID NO:6);
xxxvi) HAPLN3 (SEQ ID NO:4), ST6GALNAC3 (SEQ ID NO:5) and ZNF660 (SEQ ID NO:6);
xxxvii) AOX1 (SEQ ID NO:1), C1orf114 (SEQ ID NO:2) and GAS6 (SEQ ID NO:3) and ST6GALNAC3 (SEQ ID NO:5);
xxxviii) AOX1 (SEQ ID NO:1), C1orf114 (SEQ ID NO:2) GAS6 (SEQ ID NO:3) and ZNF660 (SEQ ID NO:6);
xxxix) AOX1 (SEQ ID NO:1), C1orf114 (SEQ ID NO:2), HAPLN3 (SEQ ID NO:4),
xl) AOX1 (SEQ ID NO:1), C1orf114 (SEQ ID NO:2), HAPLN3 (SEQ ID NO:4), and ST6GALNAC3 (SEQ ID NO:5);
xli) AOX1 (SEQ ID NO:1), C1orf114 (SEQ ID NO:2), ST6GALNAC3 (SEQ ID NO:5) and ZNF660 (SEQ ID NO:6);
xlii) AOX1 (SEQ ID NO:1), GAS6 (SEQ ID NO:3), HAPLN3 (SEQ ID NO:4) and ST6GALNAC3 (SEQ ID NO:5);
xliii) AOX1 (SEQ ID NO:1), GAS6 (SEQ ID NO:3) and HAPLN3 (SEQ ID NO:4);
xliv) AOX1 (SEQ ID NO:1), GAS6 (SEQ ID NO:3) and ST6GALNAC3 (SEQ ID NO:5);
xlv) AOX1 (SEQ ID NO:1), HAPLN3 (SEQ ID NO:4), ST6GALNAC3 (SEQ ID NO:5) and ZNF660 (SEQ ID NO:6);
xlvi) C1orf114 (SEQ ID NO:2), GAS6 (SEQ ID NO:3), HAPLN3 (SEQ ID NO:4) and ST6GALNAC3 (SEQ ID NO:5);
xlvii) C1orf114 (SEQ ID NO:2), GAS6 (SEQ ID NO:3), HAPLN3 (SEQ ID NO:4) and ZNF660 (SEQ ID NO:6);
xlviii) C1orf114 (SEQ ID NO:2), GAS6 (SEQ ID NO:3), ST6GALNAC3 (SEQ ID NO:5) and ZNF660 (SEQ ID NO:6);

xlix) C1orf114 (SEQ ID NO:2), HAPLN3 (SEQ ID NO:4), ST6GALNAC3 (SEQ ID NO:5) and ZNF660 (SEQ ID NO:6);
l) GAS6 (SEQ ID NO:3), HAPLN3 (SEQ ID NO:4), ST6GALNAC3 (SEQ ID NO:5) and ZNF660 (SEQ ID NO:6);
li) AOX1 (SEQ ID NO:1), C1orf114 (SEQ ID NO:2), GAS6 (SEQ ID NO:3), HAPLN3 (SEQ ID NO:4) and ST6GALNAC3 (SEQ ID NO:5);
lii) AOX1 (SEQ ID NO:1), C1orf114 (SEQ ID NO:2), GAS6 (SEQ ID NO:3), HAPLN3 (SEQ ID NO:4) and ZNF660 (SEQ ID NO:6);
liii) AOX1 (SEQ ID NO:1), C1orf114 (SEQ ID NO:2), GAS6 (SEQ ID NO:3), ST6GALNAC3 (SEQ ID NO:5) and ZNF660 (SEQ ID NO:6);
liv) AOX1 (SEQ ID NO:1), C1orf114 (SEQ ID NO:2), HAPLN3 (SEQ ID NO:4), ST6GALNAC3 (SEQ ID NO:5) and ZNF660 (SEQ ID NO:6);
lv) AOX1 (SEQ ID NO:1), GAS6 (SEQ ID NO:3), HAPLN3 (SEQ ID NO:4), ST6GALNAC3 (SEQ ID NO:5) and ZNF660 (SEQ ID NO:6);
lvi) C1orf114 (SEQ ID NO:2), GAS6 (SEQ ID NO:3), HAPLN3 (SEQ ID NO:4),
lvii) ST6GALNAC3 (SEQ ID NO:5) and ZNF660 (SEQ ID NO:6); AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6); wherein any one of said SEQ ID NO: 1, 2, 3, 4, 5 or 6 of said panels i) through
lvii) optionally is individually replaced by:
  b') a nucleotide sequence being complementary to any one of said SEQ ID NOs: 1, 2, 3, 4, 5 or 6 of said panels i) through lvii); or
  b'') a nucleotide sequence having at least 90% sequence identity to any one of said SEQ ID NOs: 1, 2, 3, 4, 5 or 6 of said panels i) through lvii), or the complementary nucleotide sequences of b'); or
  b''') a fragment comprising at least 15 consecutive nucleotides of any one of said SEQ ID NOs: 1, 2, 3, 4, 5 or 6 of said panels i) through lvii), or the nucleotide sequences of b'), or the nucleotide sequences of b'');
c) comparing the methylation level, transcriptional level, and/or translational expression level of the sampled nucleotide sequences of b), with the corresponding methylation level, transcriptional level, and/or translational expression level of a corresponding nucleotide sequences of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

Under certain circumstances, it is advantageous to base the diagnostic use on the analysis of the characteristics of single genes. Thus in one aspect, the invention concerns a method of determining if an individual has, or is at risk of developing prostate cancer, the method comprising the steps of:
a) providing a sample obtained from said individual;
b) determining in the sample of a),
  the methylation level, and/or
  the transcriptional expression level, and/or
  the translational expression level,
  of one or more nucleotide sequences selected from the group consisting of:

I') the nucleotide sequence of SEQ ID NO:5 (ST6GALNAC3); or
I'') a nucleotide sequence being complementary to SEQ ID NO: 5; or
I''') a nucleotide sequence having at least 90% sequence identity to any one of I' or I''; or
I'''') a fragment of any one of I', I'' or I''', wherein the fragment comprises at least 15 consecutive nucleotides of any one of I', I'' or I'''; and
II') the nucleotide sequence of SEQ ID NO:6 (ZNF660); or
II'') a nucleotide sequence being complementary to SEQ ID NO: 6; or
II''') a nucleotide sequence having at least 90% sequence identity to any one of II' or II''; or
II'''') a fragment of any one of II', II'' or II''', wherein the fragment comprises at least 15 consecutive nucleotides of any one of II', II'' or II'''; and
c) comparing the methylation level, transcriptional level, and/or translational expression level of the sampled nucleotide sequence of b), with the corresponding methylation level, transcriptional level, and/or translational expression level of a corresponding nucleotide sequence of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

The present invention additionally provides methods for assisting in determining treatment strategy. In one such aspect, the invention concerns a method of identifying a prostate cancer patient in need of adjuvant therapy, comprising:
a) providing a sample obtained from cancerous tissue of an individual;
b) determining in the sample of a),
  the methylation level, and/or
  the transcriptional expression level, and/or
  the translational expression level,
  of one or more biomarkers, wherein the biomarkers are nucleotide sequences selected from the group consisting of:
I') the nucleotide sequence of SEQ ID NO:3 (GAS6); or
I'') a nucleotide sequence being complementary to SEQ ID NO: 3; or
I''') a nucleotide sequence having at least 90% sequence identity to any one of I' or I''; or
I'''') a fragment of any one of I', I'' or I''', wherein the fragment comprises at least 15 consecutive nucleotides of any one of I', I'' or I'''; and
II') the nucleotide sequence of SEQ ID NO:4 (HAPLN3); or
II'') a nucleotide sequence being complementary to SEQ ID NO: 4; or
II''') a nucleotide sequence having at least 90% sequence identity to any one of II' or II''; or
II'''') a fragment of any one of II', II'' or II''', wherein the fragment comprises at least 15 consecutive nucleotides of any one of I', I'' or I'''; and
III') the nucleotide sequence of SEQ ID NO:1 (AOX1); or
III'') a nucleotide sequence being complementary to SEQ ID NO: 1; or
III''') a nucleotide sequence having at least 90% sequence identity to any one of III' or III''; or III'''') a fragment of any one of III', III'' or III''', wherein the fragment comprises at least 15 consecutive nucleotides of any one of III', III'' or III'''; and IV') the nucleotide sequence of SEQ ID NO:2 (C1orf114); or IV'') a nucleotide sequence being complementary to SEQ ID NO: 2; or IV''') a nucleotide sequence having at least 90% sequence identity to any one of IV' or IV''; or IV'''') a fragment of any one of IV', IV'' or IV''', wherein the fragment comprises at least 15 consecutive nucleotides of any one of IV', IV'' or IV'''; and V') the nucleotide sequence of SEQ ID NO:5 (ST6GALNAC3); or V'') a nucleotide sequence being complementary to SEQ ID NO: 5; or V''') a nucleotide sequence having at least 90% sequence identity to any one of V' or V''; or V'''') a fragment of any one of V', V'' or V''', wherein the fragment comprises at least 15 consecutive nucleotides of any one of V', V'' or V'''; and VI') the nucleotide sequence of SEQ ID NO:6 (ZNF660); or VI'') a nucleotide sequence being complementary to SEQ ID NO: 6; or VI''') a nucleotide sequence having at least 90% sequence identity to any one of VI' or VI''; or VI'''') a fragment of any one of VI', VI'' or VI''', wherein the fragment comprises at least 15 consecutive nucleotides of any one of VI', VI'' or VI''';

c) obtaining biomarker scores based on the methylation level, transcriptional level, and/or translational expression level of the sampled nucleotide sequence of b), wherein the biomarker scores indicate if the patient is in need of adjuvant therapy.

The present invention in a further aspect concerns a method for prognosing disease progression of prostate cancer in a patient, said method comprising the steps of:

a) providing a sample obtained from cancerous tissue of an individual;

b) determining in the sample of a),
the methylation level, and/or
the transcriptional expression level, and/or
the translational expression level,
of one or more biomarkers, wherein the biomarkers are nucleotide sequences selected from the group consisting of:

I') the nucleotide sequence of SEQ ID NO:2 (C1orf114); or

I'') a nucleotide sequence being complementary to SEQ ID NO: 2; or

I''') a nucleotide sequence having at least 90% sequence identity to any one of I' or I''; or I'''') a fragment of any one of I', I'' or I''', wherein the fragment comprises at least 15 consecutive nucleotides of any one of I', I'' or I'''; and II') the nucleotide sequence of SEQ ID NO:4 (HAPLN3); or II'') a nucleotide sequence being complementary to SEQ ID NO: 4; or II''') a nucleotide sequence having at least 90% sequence identity to any one of II' or II''; or II'''') a fragment of any one of II', II'' or II''', wherein the fragment comprises at least 15 consecutive nucleotides of any one of I', I'' or I'''; and III') the nucleotide sequence of SEQ ID NO:1 (AOX1); or III'') a nucleotide sequence being complementary to SEQ ID NO: 1; or III''') a nucleotide sequence having at least 90% sequence identity to any one of III' or II'''; or III'''') a fragment of any one of III', III'' or III''', wherein the fragment comprises at least 15 consecutive nucleotides of any one of III', III'' or II'''; and IV') the nucleotide sequence of SEQ ID NO:3 (GAS6); or IV'') a nucleotide sequence being complementary to SEQ ID NO: 4; or IV''') a nucleotide sequence having at least 90% sequence identity to any one of IV' or IV''; or IV'''') a fragment of any one of IV', IV'' or IV''', wherein the fragment comprises at least 15 consecutive nucleotides of any one of IV', IV'' or IV'''; and V') the nucleotide sequence of SEQ ID NO:5 (ST6GALNAC3); or V'') a nucleotide sequence being complementary to SEQ ID NO: 5; or V''') a nucleotide sequence having at least 90% sequence identity to any one of V' or V''; or V'''') a fragment of any one of V', V'' or V''', wherein the fragment comprises at least 15 consecutive nucleotides of any one of V', V'' or V'''; and VI') the nucleotide sequence of SEQ ID NO:6 (ZNF660); or VI'') a nucleotide sequence being complementary to SEQ ID NO: 6; or VI''') a nucleotide sequence having at least 90% sequence identity to any one of VI' or VI''; or VI'''') a fragment of any one of VI', VI'' or VI''', wherein the fragment comprises at least 15 consecutive nucleotides of any one of VI', VI'' or VI''';

c) obtaining a biomarker score based on the methylation level, transcriptional level, and/or translational expression level of the sampled nucleotide sequence of b), wherein the biomarker score is indicative of the prognosis of the prostate cancer patient.

As mentioned above, panels of different combinations of genes have been designed and, wherein each panel is suitable for a particular purpose. One such purpose is to prognosing, i.e. determining disease progression of prostate cancer. Thus in one important aspect the invention concerns a method for prognosing disease progression of prostate cancer in a patient, said method comprising the steps of:

a) providing a sample obtained from cancerous tissue of an individual;

b) determining in the sample of a),
the methylation level, and/or
the transcriptional expression level, and/or
the translational expression level,
of a panel comprising one or more nucleotide sequences, wherein the panel is selected from the group consisting of:

i) C1orf114 (SEQ ID NO:2) and HAPLN3 (SEQ ID NO:4);

ii) AOX (SEQ ID NO:1) and C1orf114 (SEQ ID NO:2);

iii) AOX (SEQ ID NO:1), C1orf114 (SEQ ID NO:2) and GAS6 (SEQ ID NO:3); iv) C1orf114 (SEQ ID NO:2), GAS6 (SEQ ID NO:3) and HAPLN3 (SEQ ID NO:4);

v) C1orf114 (SEQ ID NO:2);

vi) AOX (SEQ ID NO:1), C1orf114 (SEQ ID NO:2) and HAPLN3 (SEQ ID NO:4);

vii) AOX (SEQ ID NO:1), C1orf114 (SEQ ID NO:2), GAS6 (SEQ ID NO:3) and HAPLN3 (SEQ ID NO:4);

viii) C1orf114 (SEQ ID NO:2) and GAS6 (SEQ ID NO:3);

ix) AOX (SEQ ID NO:1) and GAS6 (SEQ ID NO:3);
x) AOX (SEQ ID NO:1);
xi) HAPLN3 (SEQ ID NO:4);
xii) AOX (SEQ ID NO:1) and HAPLN3 (SEQ ID NO:4);
xiii) AOX (SEQ ID NO:1), GAS6 (SEQ ID NO:3) and HAPLN3 (SEQ ID NO:4);
xiv) GAS6 (SEQ ID NO:3) and HAPLN3 (SEQ ID NO:4);
xv) GAS6 (SEQ ID NO:3);
xvi) ST6GALNAC3 (SEQ ID NO:5);
xvii) ZNF660 (SEQ ID NO:6);
xviii) AOX (SEQ ID NO:1) and ST6GALNAC3 (SEQ ID NO:5);
xix) AOX (SEQ ID NO:1) and ZNF660 (SEQ ID NO:6);
xx) C1orf114 (SEQ ID NO:2) and ST6GALNAC3 (SEQ ID NO:5);
xxi) C1orf114 (SEQ ID NO:2) and ZNF660 (SEQ ID NO:6);
xxii) GAS6 (SEQ ID NO:3) and ST6GALNAC3 (SEQ ID NO:5);
xxiii) GAS6 (SEQ ID NO:3) and ZNF660 (SEQ ID NO:6);
xxiv) HAPLN3 (SEQ ID NO:4) and ST6GALNAC3 (SEQ ID NO:5);
xxv) HAPLN3 (SEQ ID NO:4) and ZNF660 (SEQ ID NO:6);
xxvi) ST6GALNAC3 (SEQ ID NO:5) and ZNF660 (SEQ ID NO:6);
xxvii) AOX (SEQ ID NO:1), C1orf114 (SEQ ID NO:2) and ST6GALNAC3 (SEQ ID NO:5);
xxviii) AOX (SEQ ID NO:1), C1orf114 (SEQ ID NO:2) and ZNF660 (SEQ ID NO:6);
xxix) AOX (SEQ ID NO:1), GAS6 (SEQ ID NO:3) and ST6GALNAC3 (SEQ ID NO:5);
xxx) AOX (SEQ ID NO:1), GAS6 (SEQ ID NO:3) and ZNF660 (SEQ ID NO:6);
xxxi) AOX (SEQ ID NO:1), HAPLN3 (SEQ ID NO:4) and ST6GALNAC3 (SEQ ID NO:5);
xxxii) AOX (SEQ ID NO:1), HAPLN3 (SEQ ID NO:4) and ZNF660 (SEQ ID NO:6);
xxxiii) AOX (SEQ ID NO:1), ST6GALNAC3 (SEQ ID NO:5) and ZNF660 (SEQ ID NO:6);
xxxiv) C1orf114 (SEQ ID NO:2), GAS6 (SEQ ID NO:3) and ST6GALNAC3 (SEQ ID NO:5);
xxxv) C1orf114 (SEQ ID NO:2), GAS6 (SEQ ID NO:3) and ZNF660 (SEQ ID NO:6);
xxxvi) C1orf114 (SEQ ID NO:2), HAPLN3 (SEQ ID NO:4) and ST6GALNAC3 (SEQ ID NO:5);
xxxvii) C1orf114 (SEQ ID NO:2), HAPLN3 (SEQ ID NO:4) and ZNF660 (SEQ ID NO:6);
xxxviii) C1orf114 (SEQ ID NO:2), ST6GALNAC3 (SEQ ID NO:5) and ZNF660 (SEQ ID NO:6);
xxxix) GAS6 (SEQ ID NO:3), HAPLN3 (SEQ ID NO:4) and ST6GALNAC3 (SEQ ID NO:5);
xl) GAS6 (SEQ ID NO:3), HAPLN3 (SEQ ID NO:4) and ZNF660 (SEQ ID NO:6);
xli) GAS6 (SEQ ID NO:3), ST6GALNAC3 (SEQ ID NO:5) and ZNF660 (SEQ ID NO:6);
xlii) HAPLN3 (SEQ ID NO:4), ST6GALNAC3 (SEQ ID NO:5) and ZNF660 (SEQ ID NO:6);
xliii) AOX (SEQ ID NO:1), C1orf114 (SEQ ID NO:2), GAS6 (SEQ ID NO:3) and ST6GALNAC3 (SEQ ID NO:5);
xliv) AOX (SEQ ID NO:1), C1orf114 (SEQ ID NO:2), GAS6 (SEQ ID NO:3) and ZNF660 (SEQ ID NO:6);
xlv) AOX (SEQ ID NO:1), C1orf114 (SEQ ID NO:2), HAPLN3 (SEQ ID NO:4) and ST6GALNAC3 (SEQ ID NO:5);
xlvi) AOX (SEQ ID NO:1), C1orf114 (SEQ ID NO:2), HAPLN3 (SEQ ID NO:4) and ZNF660 (SEQ ID NO:6);
xlvii) AOX (SEQ ID NO:1), C1orf114 (SEQ ID NO:2), ST6GALNAC3 (SEQ ID NO:5) and ZNF660 (SEQ ID NO:6);
xlviii) AOX (SEQ ID NO:1), GAS6 (SEQ ID NO:3), HAPLN3 (SEQ ID NO:4) and ST6GALNAC3 (SEQ ID NO:5);
xlix) AOX (SEQ ID NO:1), GAS6 (SEQ ID NO:3), HAPLN3 (SEQ ID NO:4) and ZNF660 (SEQ ID NO:6);
l) AOX (SEQ ID NO:1), GAS6 (SEQ ID NO:3), ST6GALNAC3 (SEQ ID NO:5) and ZNF660 (SEQ ID NO:6);
li) AOX (SEQ ID NO:1), HAPLN3 (SEQ ID NO:4), ST6GALNAC3 (SEQ ID NO:5) and ZNF660 (SEQ ID NO:6);
lii) C1orf114 (SEQ ID NO:2), GAS6 (SEQ ID NO:3), HAPLN3 (SEQ ID NO:4) and ST6GALNAC3 (SEQ ID NO:5);
liii) C1orf114 (SEQ ID NO:2), GAS6 (SEQ ID NO:3), HAPLN3 (SEQ ID NO:4) and ZNF660 (SEQ ID NO:6);
liv) C1orf114 (SEQ ID NO:2), GAS6 (SEQ ID NO:3), ST6GALNAC3 (SEQ ID NO:5) and ZNF660 (SEQ ID NO:6);
lv) C1orf114 (SEQ ID NO:2), HAPLN3 (SEQ ID NO:4), ST6GALNAC3 (SEQ ID NO:5) and ZNF660 (SEQ ID NO:6);
lvi) GAS6 (SEQ ID NO:3), HAPLN3 (SEQ ID NO:4), ST6GALNAC3 (SEQ ID NO:5) and ZNF660 (SEQ ID NO:6);
lvii) AOX (SEQ ID NO:1), C1orf114 (SEQ ID NO:2), GAS6 (SEQ ID NO:3), HAPLN3 (SEQ ID NO:4) and ST6GALNAC3 (SEQ ID NO:5);
lviii) AOX (SEQ ID NO:1), C1orf114 (SEQ ID NO:2), GAS6 (SEQ ID NO:3), HAPLN3 (SEQ ID NO:4) and ZNF660 (SEQ ID NO:6);
lix) AOX (SEQ ID NO:1), C1orf114 (SEQ ID NO:2), GAS6 (SEQ ID NO:3), ST6GALNAC3 (SEQ ID NO:5) and ZNF660 (SEQ ID NO:6);
lx) AOX (SEQ ID NO:1), C1orf114 (SEQ ID NO:2), HAPLN3 (SEQ ID NO:4), ST6GALNAC3 (SEQ ID NO:5) and ZNF660 (SEQ ID NO:6);
lxi) AOX (SEQ ID NO:1), GAS6 (SEQ ID NO:3), HAPLN3 (SEQ ID NO:4), ST6GALNAC3 (SEQ ID NO:5) and ZNF660 (SEQ ID NO:6);
lxii) C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);
lxiii) AOX (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);

wherein any one of said SEQ ID NO: 1, 2, 3, 4, 5 or 6 of said panels i) through lxiii) optionally is individually replaced by:

b') a nucleotide sequence being complementary to any one of said SEQ ID NOs: 1, 2, 3, 4, 5 or 6 of said panels i) through lvii); or b") a nucleotide sequence having at least 90% sequence identity to any one of said SEQ ID NOs: 1, 2, 3, 4, 5 or 6 of said panels i) through lvii), or the complementary nucleotide sequences of b'); or b''') a fragment comprising at least 15 consecutive nucleotides of any one of said SEQ ID NOs: 1, 2, 3, 4, 5 or 6 of said panels i) through lvii), or the nucleotide sequences of b'), or the nucleotide sequences of b'');

c) obtaining a biomarker score based on the methylation level, transcriptional level, and/or translational expression level of the sampled nucleotide sequence of b), wherein the biomarker score is indicative of the prognosis of the prostate cancer patient.

In one aspect, the invention concerns a method of determining the risk of progression of a prostate cancer patient after therapy, comprising:

a) providing a sample obtained from said patient;
b) determining in the sample of a),
the methylation level, and/or
the transcriptional expression level, and/or
the translational expression level,
of one or more biomarkers, wherein the biomarkers are nucleotide sequences selected from the group consisting of:
I') the nucleotide sequence of SEQ ID NO:2 (C1orf114); or
I'') a nucleotide sequence being complementary to SEQ ID NO: 2; or
I''') a nucleotide sequence having at least 90% sequence identity to any one of I' or I''; or
I'''') a fragment of any one of I', I'' or I''', wherein the fragment comprises at least 15 consecutive nucleotides of any one of I', I'' or I'''; and
II') the nucleotide sequence of SEQ ID NO:4 (HAPLN3); or
II'') a nucleotide sequence being complementary to SEQ ID NO: 4; or
II''') a nucleotide sequence having at least 90% sequence identity to any one of II' or II''; or
II'''') a fragment of any one of II', II'' or II''', wherein the fragment comprises at least 15 consecutive nucleotides of any one of I', I'' or I'''; and
III') the nucleotide sequence of SEQ ID NO:1 (AOX1); or
III'') a nucleotide sequence being complementary to SEQ ID NO: 1; or
III''') a nucleotide sequence having at least 90% sequence identity to any one of III' or III''; or
III'''') a fragment of any one of III', III'' or III''', wherein the fragment comprises at least 15 consecutive nucleotides of any one of III', III'' or III'''; and
IV') the nucleotide sequence of SEQ ID NO:3 (GAS6); or
IV'') a nucleotide sequence being complementary to SEQ ID NO: 4; or
IV''') a nucleotide sequence having at least 90% sequence identity to any one of IV' or IV''; or
IV'''') a fragment of any one of IV', IV'' or IV''', wherein the fragment comprises at least 15 consecutive nucleotides of any one of IV', IV'' or IV'''; and
V') the nucleotide sequence of SEQ ID NO:5 (ST6GALNAC3); or
V'') a nucleotide sequence being complementary to SEQ ID NO: 5; or
V''') a nucleotide sequence having at least 90% sequence identity to any one of V' or V''; or
V'''') a fragment of any one of V', V'' or V''', wherein the fragment comprises at least 15 consecutive nucleotides of any one of V', V'' or V'''; and
VI') the nucleotide sequence of SEQ ID NO:6 (ZNF660); or
VI'') a nucleotide sequence being complementary to SEQ ID NO: 6; or
VI''') a nucleotide sequence having at least 90% sequence identity to any one of VI' or VI''; or
VI'''') a fragment of any one of VI', VI'' or VI''', wherein the fragment comprises at least 15 consecutive nucleotides of any one of VI', VI'' or VI''';

c) obtaining a biomarker score based on the methylation level, transcriptional level, and/or translational expression level of the sampled nucleotide sequence of b);

d) correlating the methylation level, transcriptional level, and/or translational expression level with the risk of progression.

In another aspect the invention concerns a method for assisting prognosis of disease progression of prostate cancer in an individual having developed prostate cancer, the method comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of i) and/or the transcriptional level of ii) and/or the translational expression level of iii) is indicative of the outcome of prostate cancer In one aspect, the invention concerns a method for assisting in predicting and/or for predicting the outcome of prostate cancer in an individual having developed prostate cancer comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of a) and/or the transcriptional level of b) and/or the translational expression level of c) is indicative of the outcome of prostate cancer.

In another aspect the invention concerns a method for assisting in monitoring and/or for monitoring the effect of treatment on prostate cancer progression in an individual having developed prostate cancer and being treated for said prostate cancer, comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO: 1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of i) and/or the transcriptional level of ii) and/or the translational expression level of iii) is indicative of prostate cancer progression.

In another aspect the invention concerns a method for assisting in monitoring and/or for monitoring the progression of prostate cancer from a silent/indolent to an aggressive prostate cancer in an individual having developed prostate cancer comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO: 1, SEQ ID NO:3, SEQ ID NO:5, and SEQ ID NO:6 or part thereof in said sample wherein increased methylation level of a) and/or decreased transcriptional level of b) and/or decreased translational expression level of c) is indicative of the progression of prostate cancer from a silent/indolent to an aggressive prostate cancer.

In yet another aspect the invention concerns a method for assisting in determining and/or determining the treatment regime of an individual having developed prostate cancer comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample
wherein the methylation level of a) and/or the transcriptional level of b) and/or the translational expression level of c) is indicative of the treatment regime to be offered to the individual having developed prostate cancer.

In addition to the above discussed diagnostic and prognostic methods respectively, the present invention can also be applied for use in the treatment of prostate cancer. Thus in one aspect the invention concerns a method of treating a prostate cancer patient comprising determining at least one clinical parameter for said patient, determining the status of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), in a sample obtained from the patient, and (a) recommending, prescribing or initiating active treatment if said patient has at least one risk-associated clinical parameter and an elevated status for said gene, or (b) recommending, prescribing or initiating watchful waiting if said patient has neither a risk-associated clinical parameter nor an elevated status for said gene or genes.

The invention furthermore concerns tool for assessing status of a certain gene of interest. Thus in one aspect, the invention concerns the use of a plurality of oligonucleotides for determining the expression level of a panel of genes, where said panel comprises two or more biomarkers selected from:

I') the nucleotide sequence of SEQ ID NO:1 (AOX1); or

I") a nucleotide sequence being complementary to SEQ ID NO: 1; or

I"') a nucleotide sequence having at least 90% sequence identity to any one of I' or I"; or I"") a fragment of any one of I', I" or I"', wherein the fragment comprises at least 15 consecutive nucleotides of any one of I', I" or I"'; and II') the nucleotide sequence of SEQ ID NO:2 (C1orf114); or II") a nucleotide sequence being complementary to SEQ ID NO: 2; or II"') a nucleotide sequence having at least 90% sequence identity to any one of II' or II"; or II"") a fragment of any one of II', II" or II"', wherein the fragment comprises at least 15 consecutive nucleotides of any one of I', I" or I"'; and II') the nucleotide sequence of SEQ ID NO:3 (GAS6); or II") a nucleotide sequence being complementary to SEQ ID NO: 3; or III"') a nucleotide sequence having at least 90% sequence identity to any one of III' or II"'; or III"") a fragment of any one of III', III" or III"', wherein the fragment comprises at least 15 consecutive nucleotides of any one of III', III" or III"'; and IV') the nucleotide sequence of SEQ ID NO:4 (HAPLN3); or IV") a nucleotide sequence being complementary to SEQ ID NO: 4; or IV"') a nucleotide sequence having at least 90% sequence identity to any one of IV' or IV"; or IV"") a fragment of any one of IV', IV" or IV"', wherein the fragment comprises at least 15 consecutive nucleotides of any one of IV', IV" or IV"'; and V') the nucleotide sequence of SEQ ID NO:5 (ST6GALNAC3 (SEQ ID NO:5)); or V") a nucleotide sequence being complementary to SEQ ID NO: 5; or V"') a nucleotide sequence having at least 90% sequence identity to any one of V' or V"; or V"") a fragment of any one of V', V" or V"', wherein the fragment comprises at least 15 consecutive nucleotides of any one of V', V" or V"'; and VI') the nucleotide sequence of SEQ ID NO:6 (ZNF660); or VI") a nucleotide sequence being complementary to SEQ ID NO: 6; or VI"') a nucleotide sequence having at least 90% sequence identity to any one of VI' or VI"; or VI"") a fragment of any one of VI', VI" or VI"', wherein the fragment comprises at least 15 consecutive nucleotides of any one of VI', VI" or VI"';

for the manufacture of a diagnostic product useful to determine the prognosis or likelihood of recurrence of prostate cancer in an individual.

In order to assist clinicians, the diagnostic and/or prognostic uses may be implemented in a computer. In one such aspect, the present invention concerns a system for predicting the prognosis of an individual with prostate cancer, comprising:

a) means for analysing the methylation level, transcriptional level, and/or translational expression levels of one or more biomarkers in a sample obtained from said individual, and b) means for estimating the probability for a patient with prostate cancer of surviving for a certain period of time, wherein said biomarker comprises one or more nucleotide sequences selected from the group consisting of:

I') the nucleotide sequence of SEQ ID NO:1 (AOX1); or

I") a nucleotide sequence being complementary to SEQ ID NO: 1; or

I"') a nucleotide sequence having at least 90% sequence identity to any one of I' or I"; or I"") a fragment of any one of I', I" or I"', wherein the fragment comprises at least 15 consecutive nucleotides of any one of I', I" or I"'; and II') the nucleotide sequence of SEQ ID NO:2 (C1orf114); or II") a nucleotide sequence being complementary to SEQ ID NO: 2; or II"') a nucleotide sequence having at least 90% sequence identity to any one of II' or II"; or II"") a fragment of any one of II', II" or II"', wherein the fragment comprises at least 15 consecutive nucleotides of any one of I', I" or I"'; and III') the nucleotide sequence of SEQ ID NO:3 (GAS6); or III") a nucleotide sequence being complementary to SEQ ID NO: 3; or III"') a nucleotide sequence having at least 90% sequence identity to any one of III' or III"; or III"") a fragment of any one of III', III" or III"', wherein the fragment comprises at least 15 consecutive nucleotides of any one of III', III" or III"'; and IV') the nucleotide sequence of SEQ ID NO:4 (HAPLN3); or IV") a nucleotide sequence being complementary to SEQ ID NO: 4; or IV"') a nucleotide sequence having at least 90% sequence identity to any one of IV' or IV"; or IV"") a fragment of any one of IV', IV" or IV"', wherein the fragment comprises at least 15 consecutive nucleotides of any one of IV', IV" or IV"'; and V') the nucleotide sequence of SEQ ID NO:5 (ST6GALNAC3 (SEQ ID NO:5)); or V") a nucleotide sequence being complementary to SEQ ID NO: 5; or V''') a nucleotide sequence having at least 90% sequence identity to any one of V' or V"; or V'''') a fragment of any one of V', V" or V''', wherein the fragment comprises at least 15 consecutive nucleotides of any one of V', V" or V'''; and VI') the nucleotide sequence of SEQ ID NO:6 (ZNF660); or VI") a nucleotide sequence being complementary to SEQ ID NO: 6; or VI''') a nucleotide sequence having at least 90% sequence identity to any one of VI' or VI'''; or VI'''') a fragment of any one of VI', VI" or VI''', wherein the fragment comprises at least 15 consecutive nucleotides of any one of VI', VI" or VI'''.

In one aspect the invention concerns a computer readable medium comprising a computer program product having, said computer program product providing a system for predicting the prognosis of an individual, said computer program product comprising means for carrying out any of the steps of the methods outlined herein above.

In a related aspect, the invention concerns an apparatus for predicting a probability of disease recurrence in a patient with prostate cancer following a radical prostatectomy, which apparatus comprises: a) a correlation of a set of pre-operative factors for each of a plurality of persons previously diagnosed with prostatic cancer and having been treated by radical prostatectomy with the incidence of recurrence of prostatic cancer for each person of the plurality of persons, wherein the set of pre-operative factors comprises pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade; and b) a means for comparing an identical set of pre-operative factors determined from a patient diagnosed as having prostate cancer to the correlation to predict the quantitative probability of recurrence of prostate cancer in the patient following radical prostatectomy.

The invention furthermore in one aspect concerns a method for predicting a probability of recurrence of prostate cancer in a patient following radical prostatectomy, comprising correlating a set of pre-operative factors for the patient to a functional representation of a set of pre-operative factors determined for each of a plurality of persons previously diagnosed with prostatic cancer and having been treated by radical prostatectomy, so as to yield a value for total points for the patient, which set of factors for each of a plurality of persons is correlated with the incidence of recurrence of prostatic cancer for each person in the plurality of persons, wherein the set of pre-operative factors comprises pre-treatment methylation level, transcriptional level, and/or translational expression levels of one or more genes selected from the group consisting of: C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade, wherein the functional representation comprises a scale for each of pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally a scale for one or more of pre-treatment PSA level, primary Gleason grade or secondary Gleason grade, a points scale, a total points scale, and a predictor scale, wherein the scales for pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade, each have values on the scales which can be correlated with values on the points scale, and wherein the total points scale has values which may be correlated with values on the predictor scale; and b) correlating the value on the total points scale for the patient with a value on the predictor scale to predict the quantitative probability of recurrence of prostatic cancer in the patient following radical prostatectomy.

DESCRIPTION OF DRAWINGS

FIGS. 13A-13C. Bisufite sequencing data summary. A: ADJ-N and BPH samples. B: RP samples. C: MPC samples. % meth all seq: Frequency of methylated CpG sites in all sites assayed in all sequences. % meth most meth seq: Frequency of methylated CpG sites in most methylated sequence in each sample. Light grey: 0-20% methylation. Light-medium dark grey: 20-50% methylation. Medium dark-dark grey: 50-80% methylation. Dark grey: 80-100% methylation.

DETAILED DESCRIPTION OF THE INVENTION

Definitions

Figure 1:
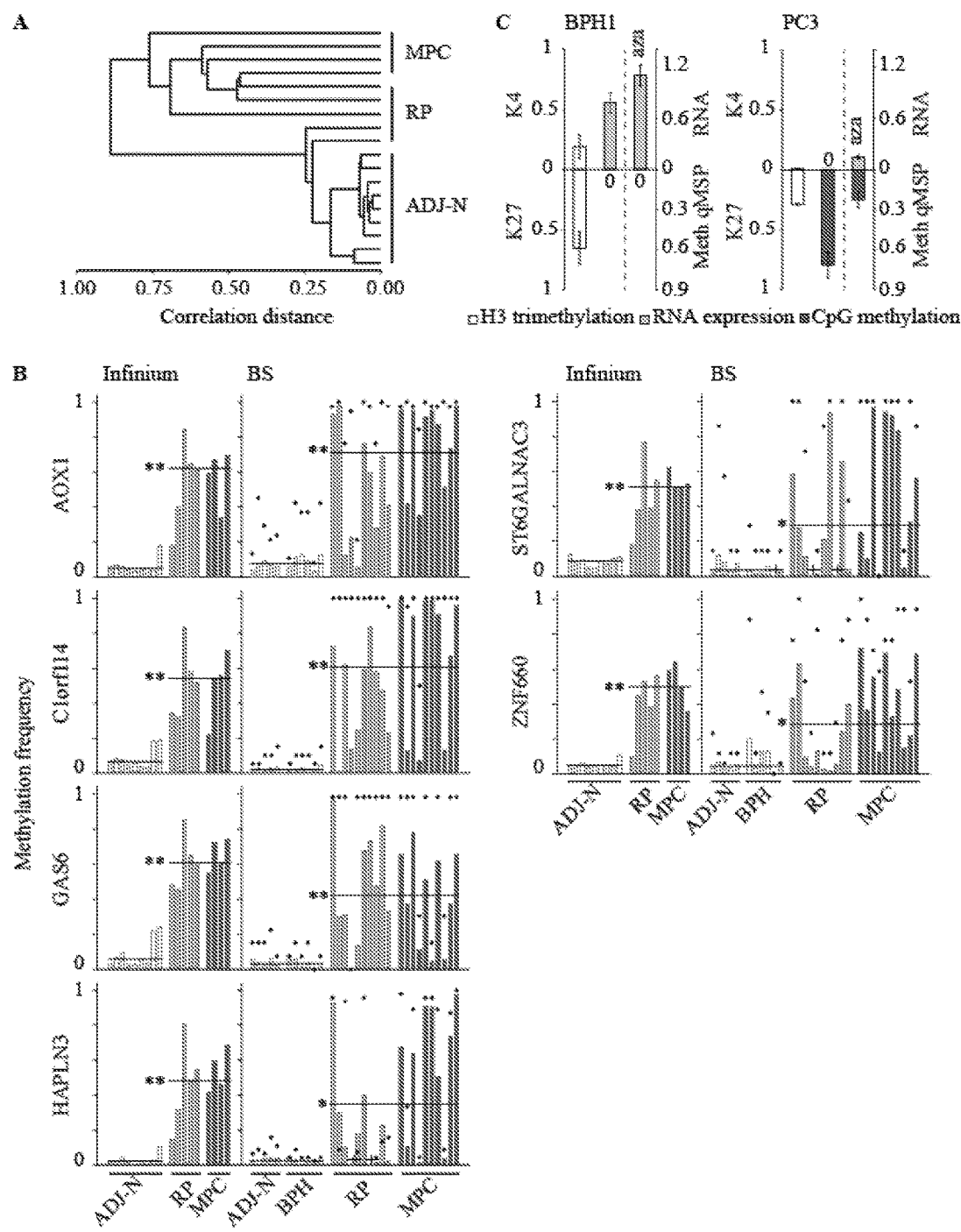
FIG. 1. Cluster analysis, methylation frequencies of candidate genes and characterization of the C1orf114 promoter region. A Unsupervised clustering of samples based on most variably methylated CpG sites across all patient samples (variance>0.03) using the correlation algorithm of GenomeStudio. B Infinium β-values of 9 adjacent normal (ADJ-N), 5 localized prostate cancer (RP) and 4 metastatic prostate cancer (MPC, primary tumour) samples for the six methylation marker candidates as well as methylation frequencies found by bisulfite sequencing of DNA purified from 31 fresh-frozen macro-dissected prostate tissue specimens ADJ-N (n=5), benign prostatic hyperplasia (BPH) (n=6), RP (n=10) and MPCs (n=10). Each bar represents the β-value (Infinium data) or the percentage of methylated CpGs in each patient sample (bisulfite sequencing data). White bars: ADJ-N or BPH, light grey bars: RP, dark grey bars: MPC samples. Black line: median. *P<0.01, **P<0.001 Mann Whitney U-test. Black dots indicate methylation frequency of most methylated sequence in each patient sample analyzed by bisulfite sequencing. C Characterization of the C1orf114 promoter region and RNA expression in BPH1 and PC3 cell lines. H3K4me3 and H3K27me3 were normalized to GAPDH and COL2A1 H3K4me3 and H3K27me3 levels, respectively, in the same cell lines. DNA methylation (qMSP data) normalized to MYOD1 and RNA expression normalized to UBC was determined in untreated or 5-aza-dC treated cells.
Figure 2:
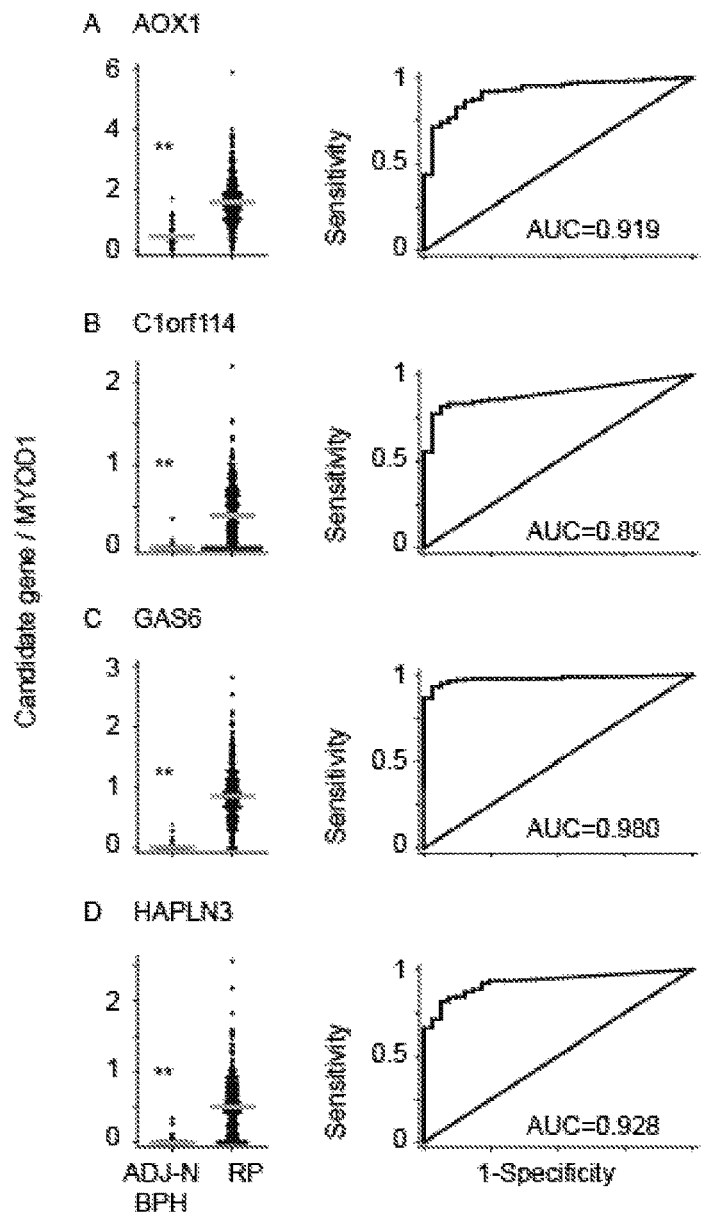
FIG. 2. Diagnostic potential of candidate methylation markers. ROC analysis of non-malignant samples (ADJ-N and BPH) (n=35) against RP samples (n=293). Left panel: dotplots illustrating methylation levels of non-malignant and RP samples. Black line: median. **P<0.0001 Mann-Whitney U test. Right panel: ROC curves using data displayed in dotplots. AUC: area under the curve.

The term "biomarker" as used herein refers to a gene or a nucleotide sequence, wherein the methylation level, methylation incidence, transcriptional expression level and/or translational expression level indicate the presence or the absence of prostate cancer. In one preferred embodiment the biomarker is selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or of a nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6. The term "biomarker" may be used interchangeably with "marker".

The term "fragment" as used herein refers to a fragment comprising at least 15 consecutive nucleotides of any one of said SEQ ID NOs: 1, 2, 3, 4, 5 or 6; such as a fragment comprising at least 20 consecutive nucleotides, such as a fragment comprising at least 25 consecutive nucleotides, such as a fragment comprising at least 30 consecutive nucleotides, such as a fragment comprising at least 35 consecutive nucleotides, such as a fragment comprising at least 40 consecutive nucleotides, such as a fragment comprising at least 45 consecutive nucleotides, such as a fragment comprising at least 50 consecutive nucleotides, such as a fragment comprising at least 55 consecutive nucleotides, such as a fragment comprising at least 60 consecutive nucleotides, such as a fragment comprising at least 65 consecutive nucleotides, such as a fragment comprising at least 70 consecutive nucleotides, such as a fragment comprising at least 75 consecutive nucleotides, such as a fragment comprising at least 80 consecutive nucleotides, such as a fragment comprising at least 85 consecutive nucleotides, such as a fragment comprising at least 90 consecutive nucleotides, such as a fragment comprising at least 95 consecutive nucleotides, such as a fragment comprising at least 100 consecutive nucleotides, such as a fragment comprising at least 150 consecutive nucleotides, such as a fragment comprising at least 200 consecutive nucleotides, such as a fragment comprising at least 250 consecutive nucleotides, such as a fragment comprising at least 300 consecutive nucleotides, such as a fragment comprising at least 350 consecutive nucleotides, such as a fragment comprising at least 400 consecutive nucleotides, such as a fragment comprising at least 450 consecutive nucleotides, such as a fragment comprising at least 500 consecutive nucleotides, such as a fragment comprising at least 600 consecutive nucleotides, such as a fragment comprising at least 700 consecutive nucleotides, such as a fragment comprising at least 800 consecutive nucleotides, such as a fragment comprising at least 900 consecutive nucleotides, such as a fragment comprising at least 1000 consecutive nucleotides, such as a fragment comprising at least 2000 consecutive nucleotides, such as a fragment comprising at least 3000 consecutive nucleotides, such as a fragment comprising at least 4000 consecutive nucleotides, such as a fragment comprising at least 5000 consecutive nucleotides, such as a fragment comprising at least 6000 consecutive nucleotides, such as a fragment comprising at least 7000 consecutive nucleotides, such as a fragment comprising at least 8000 consecutive nucleotides, such as a fragment comprising at least 9000 consecutive nucleotides, such as a fragment comprising at least 10000 or more consecutive nucleotides of any one of said SEQ ID NOs: 1, 2, 3, 4, 5 or 6 or said complementary sequence or said variant thereof.

The term "methylation status" as used herein refers to the methylation level such as the methylation degree and/or the methylation incidence of a gene.

The term 'assisting' as used to describe the methods herein is to emphasise that the methods herein are directed at the step of gathering data to assist in the diagnosis, prediction, and/or prognosis of prostate cancer. Accordingly, methods for assisting in such methods are not to be construed as diagnostic methods practised on the human body per se.

The term 'individual' as used herein refers to a mammal, such as a human being, e.g. a male human being, such as a male human being afflicted with prostate cancer. The term individual may in certain embodiments refer to a patient.

The terms 'prediction, predictive, predicting' are used herein as terms for predicting the outcome or disease progression following intervention for example in the form of surgery, medication etc. For example such an intervention may be radical prostatectomy.

The term "progression of prostate cancer" as used herein refers to the progression of the course of disease and/or the progression of the individual stages or grades of prostate cancer. The stage of prostate cancer may be defined using the TMN system as described elsewhere herein. The grade of prostate cancer by be defined using the Gleason grading system as described elsewhere herein.

The term "absence of prostate cancer" as used herein refers to a stage wherein prostate cancer cannot be detected by taking a tissue sample from the prostate gland and examine the tissue sample under a microscope to determine whether cancer cells are present. The absence of cancer cells indicates the absence of prostate cancer.

The term "presence of prostate cancer" as used herein refers to a stage wherein prostate cancer can be detected by taking a tissue sample from the prostate gland and examine the tissue sample under a microscope to determine whether cancer cells are present. The presence of cancer cells indicates the presence of prostate cancer.

The term "methylation" or "DNA methylation" as used herein refers to the addition of a methyl group to the 5 position of the cytosine pyrimidine ring. The methylation reaction involves flipping a target cytosine out of an intact double helix thereby allowing the transfer of a methyl group from S-adenosylmethionine in a cleft of the enzyme DNA (cystosine-5)-methyltransferase to form 5-methylcytosine (5-mCyt).

The term "hypermethylation" as used herein refers to an increase in the methylation of cytosine residues in DNA when compared to an unmethylated DNA sample The term "expression level" as used herein refers to the level of transcripts or part thereof, or protein or part thereof in a given sample, for example in a tissue sample. The level of protein can be determined by for example immunohistochemistry or other methods using antibodies that specifically recognize protein or fragment thereof. The level of transcript is determined by for example quantitative RT-PCR with normalisation to at least one relevant other gene.

A nucleotide is herein defined as a monomer of RNA or DNA. A nucleotide is a ribose or a deoxyribose ring attached to both a base and a phosphate group. Both mono-, di-, and tri-phosphate nucleosides are referred to as nucleotides.

The term "dinucleotide" as used herein refers to two sequential nucleotides. The dinucleotide may be comprised in an oligonucleotide or a polynucleotide. In particular, the dinucleotide CpG, which denotes a cytosine linked to a guanine by a phosphodiester bond, may be comprised in an oligonucleotide according to the present invention. A CpG dinucleotide is also herein referred to as a CpG site.

Prostate Cancer

The present inventors have found that the genes AOX1, C1orf114, GAS6, HAPLN3, ST6GALNAC3 and ZNF660 are useful as biomarkers for prostate cancer for use in a method for assisting in diagnosing and/or for diagnosing prostate cancer in an individual and/or a method for assisting in prognosing and/or for prognosing the disease progression of prostate cancer in an individual having developed prostate cancer and/or a method for assisting in predicting and/or for predicting the outcome of prostate cancer in an individual having developed prostate cancer and/or a method for assisting in monitoring and/or for monitoring the effect of treatment on prostate cancer progression in an individual having developed prostate cancer and being treated for said prostate cancer and/or a method for assisting in monitoring and/or for monitoring the progression of prostate cancer from a silent/indolent to an aggressive prostate cancer in an individual having developed prostate cancer and/or a method for assisting in determining and/or determining the treatment regime of an individual having developed prostate cancer.

Prostate cancer is a disease wherein cancer develops in the prostate gland of the male reproductive system. Thus, prostate cancer is classified as an adenocarcinoma (glandular cancer) in which normal secretorial prostate gland cells mutate into cancer cells. The region of prostate gland where the adenocarcinoma is most common is the peripheral zone. Initially, small clumps of cancer cells remain confined to otherwise normal prostate glands, a condition known as carcinoma in situ or prostatic intraepithelial neoplasia (PIN). Although PIN has not been proven to be a cancer precursor, it is closely associated with cancer. Over time these cancer cells begin to multiply and spread to the surrounding prostate tissue, known as the stroma, forming a tumour. Eventually, the tumour may grow large enough to invade nearby organs such as the seminal vesicles or the rectum, or the tumour cells may develop the ability to travel in the bloodstream and lymphatic system. Prostate cancer is a malignant neoplasm because it displays the three key malignant properties of cancers: Uncontrolled growth (division beyond the normal limits), invasion (intrusion on and destruction of adjacent tissues), and sometimes metastasis (spread to other locations in the body via lymph or blood). Prostate cancer most commonly metastasizes to the bones, lymph nodes, rectum, and bladder.

Prostate cancer is evaluated by the stage of the cancer i.e., how much the cancer has spread. As for the marker in the present invention, knowledge of the stage is useful in defining the prognosis of prostate cancer and for deciding on treatment regimes. The three stage TNM system (Tumour/Nodes/Metastases) is widely used for staging prostate cancer. The system makes use of information regarding the size of the tumour, the number of involved lymph nodes, and the presence of any other metastases.

The most important distinction is whether or not the cancer is still confined to the prostate. In the TNM system, clinical T1 and T2 cancers are found only in the prostate, while T3 and T4 cancers have spread elsewhere. The following terms of the TNM system are used to stage a prostate cancer:

| T—primary tumour | |
|---|---|
| Tx | Primary tumour cannot be assessed |
| T0 | No evidence of primary tumour |
| T1 | Clinically inapparent tumour neither palpable nor visible by imaging: |
| 1a | Tumour incidental histologic finding in 5% or less of tissue resected |

| T—primary tumour (continued) | |
|---|---|
| 1b | Tumour incidental histologic finding in more than 5% of tissue resected |
| 1c | Tumour identified by needle biopsy (e.g. because of elevated PSA) |
| T2 | Tumour confined within the prostate[1]: |
| 2a | Tumour involves one-half of one lobe or less |
| 2b | Tumour involves more than one-half of one lobe but not both lobes |
| 2c | Tumour involves both lobes |
| T3 | Tumour extends through the prostatic capsule[2]: |
| 3a | Extracapsular extension in periprostatic tissue (unilateral or bilateral) |
| 3b | Invasion of the seminal vesicle(s) |
| T4 | Tumour is fixed or invades adjacent structures other than the seminal vesicles: bladder neck, external sphincter, rectum, levator muscles, or pelvic wall[3] |

[1]Tumour found in one or both lobes by needle biopsy, but not palpable or visible by imaging, is classified as T1c.
[2]invasion into the prostatic apex but not beyond the prostate is not classified as T3, but as T2.
[3]If radical prostatectomy shows that the bladder neck contains microscopic tumour, this must be classified as T3a.

| N—Regional lymph nodes | |
|---|---|
| Nx | Regional lymph nodes cannot be assessed |
| N0 | No regional lymph node metastases |
| N1 | Metastasis in regional lymph nodes |

| M—Distant metastasis | |
|---|---|
| Mx | Distant metastasis cannot be assessed |
| M0 | No distant metastasis |
| M1 | Distant metastasis |
| 1a | Non-regional lymph nodes |
| 1b | Bone(s) |
| 1c | Other site(s) |

Tissue samples are examined microscopically to determine the features of any cancer identified. The so-called Gleason-score is used to help evaluating the prognosis of individuals having developed prostate cancer. Upon examination of biopsy samples under a microscope a pathologist assigns grades to the most common tumour pattern of the sample. The two grades are added together to get a Gleason score. The grades range from 1 to 5, with 5 having the worst prognosis. The Gleason scores range from 2 to 10, with 10 having the worst prognosis.

Gleason scores are associated with the following features: Grade 1—The cancerous prostate closely resembles normal prostate tissue. The glands are small, well-formed, and closely packed; Grade 2—The tissue still has well-formed glands, but they are larger and have more tissue between them; Grade 3—The tissue still has recognizable glands, but the cells are darker. At high magnification, some of these cells have left the glands and are beginning to invade the surrounding tissue; Grade 4—The tissue has few recognizable glands. Many cells are invading the surrounding tissue; Grade 5—The tissue does not have recognizable glands. There are often just sheets of cells throughout the surrounding tissue.

Samples

The sample that is used in the methods of the present invention may be in a form suitable to allow analysis by the skilled artisan. The samples according to the present invention may be selected from a tissue sample, or from body fluid samples such as samples selected from the group consisting of blood, plasma, serum, semen and urine.

In a preferred embodiment of the present invention the sample is selected from the group consisting of tissue samples, preferably a prostate sample or the sample is selected from the group consisting of blood, plasma, serum, and semen samples. In another preferred embodiment the sample is a urine sample.

In case of urine samples a preferred urine sample is a urine sample taken after the prostate gland has been massaged prior to the sampling in order to transfer as many cells of prostate origin to the urine.

In another particular embodiment of the present invention, the sample is a tissue sample, such as a biopsy of the tissue, or a superficial sample scraped from the tissue. In another embodiment the sample may be prepared by forming a suspension of cells made from the tissue. The sample may, however, also be an extract obtained from the tissue or obtained from a cell suspension made from the tissue.

In a preferred embodiment the sample used in the methods of the present invention is a biopsy of the prostate gland or resected prostate tissue. Biopsy or tissue samples may also be obtained by transurethral resection of the prostate (TURP).

In one embodiment the sample is a histopathologically negative biopsy. A histopathologically negative biopsy is a biopsy or tissue sample, wherein it has been determined by microscopic examination of the tissue that the sample is negative, i.e. the individual from which the sample is taken does not have prostate cancer.

Working with tumour material in general requires biopsies or body fluids suspected to comprise relevant cells. Working with RNA in general requires freshly frozen or immediately processed biopsies, or chemical pretreatment of the biopsy. Apart from the cancer tissue, biopsies do normally contain many different cell types, such as cells present in the blood, connective and muscle tissue, endothelium etc. In the case of DNA studies, microdissection or laser capture are methods of choice, however the time-dependent degradation of RNA may make it difficult to perform manipulation of the tissue for more than a few minutes. The sample may be fresh or frozen, or treated with chemicals.

Determining the Methylation Level

The methods of the present invention comprises a step of determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 85% sequence identity, such as at least 90% sequence identity, at least 95% sequence identity, such as at least 99% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof.

In the present invention, an increased methylation level, such as an increased methylation degree and/or methylation incidence, is indicative of the presence of prostate cancer and a decreased methylation degree and/or methylation incidence is indicative of the absence of prostate cancer.

The methylation degree as used herein refers to an average value of the percentage of all CpG dinucleotides on a region of the AOX1, C1orf114, GAS6, HAPLN3, ST6GALNAC3 and ZNF660 gene being methylated in all cells of a given sample. The sample may be any of the samples mentioned herein and above in the section "Samples", such as for example a tissue sample, a blood, serum, plasma, semen or urine sample. The sample may therefore comprise a variety of cells, such as for example a mixture of prostate cancer cells and non-malignant cells. By way of example, if there are 10 CpG dinucleotides on a given region of the AOX1 gene, and 2 CpG dinucleotides are methylated, then the methylation degree is 20%. However, if only 10% of the cells in a sample is prostate cancer cells, the methylation degree is 2%. Therefore, the methylation degree in a urine sample from an individual having prostate cancer may typically be lower than the methylation degree in a tissue sample from the same individual, because the fraction of malignant cells in a urine sample are typically smaller than in a tissue sample.

The methylation degree may also be measured relative to a control sample. In one embodiment the control sample is an unmethylated nucleotide sequence having at least 90% sequence identity with SEQ ID NO: 1, SEQ ID NO: 2, SEQ ID NO: 3, SEQ ID NO: 4, SEQ ID NO: 5 and/or SEQ ID NO: 6 or part thereof. In another embodiment the control sample is a fully methylated nucleotide sequence having at least 90% sequence identity with SEQ ID NO: 1, SEQ ID NO: 2, SEQ ID NO: 3, SEQ ID NO: 4, SEQ ID NO: 5 and/or SEQ ID NO: 6 or part thereof. In yet another embodiment the control sample is obtained from a healthy individual from the same tissue or body fluid as the sample of said individual.

In one embodiment the methylation degree is determined over the entire AOX1 gene according to SEQ ID NO:1.

In another embodiment the methylation degree is determined over a stretch of 10 to 90000 consecutive basepairs, such as of consecutive 10 to 70000 basepairs such as for example of 10 to 50000 consecutive basepairs, such as of 10 to 30000 consecutive basepairs, such as for example of 10 to 10000 consecutive basepairs, such as of 10 to 7000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the AOX1 gene according to SEQ ID NO:1.

In another embodiment the methylation degree is determined over a stretch of 100 to 1000 consecutive basepairs, such as for example of 100 to 800 consecutive basepairs, such as of 100 to 600 consecutive basepairs, such as for example of 100 to 200 consecutive basepairs of the AOX gene according to SEQ ID NO:1.

In one preferred embodiment the methylation degree is determined over a stretch of 100 to 500 consecutive base pairs of the AOX gene according to SEQ ID NO: 1.

In one embodiment the methylation degree is determined in the region of basepair no. 1 to basepair no. 45000 of SEQ ID NO: 1, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 45000 of SEQ ID NO: 1, more preferably over the entire region of base pair no. 1 to base pair no. 45000 of SEQ ID NO: 1.

In another embodiment the methylation degree is determined in the region of base pair no. 45000 to base pair no. 90487 of SEQ ID NO: 1, preferably the methylation degree is determined over a stretch of in the range of 100 to 1000 consecutive bp, for example in the range of 100 to 500 consecutive bp, such as in the range of 100 to 200 consecutive bp within the region of basepair no. 45000 to basepair no. 90487 of SEQ ID NO: 1, more preferably over the entire region of basepair no. 45000 to basepair no. 90487 of SEQ ID NO: 1.

In yet another embodiment the methylation degree is determined in the region of basepair no. 1 to basepair no. 15000 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 15000 of SEQ ID NO: 1, more preferably over the entire region of basepair no. 1 to basepair no. 15000 of SEQ ID NO: 1.

In a further embodiment the methylation degree is determined in the region of basepair no. 15000 to basepair no. 30000 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 15000 to basepair no. 30000 of SEQ ID NO: 1, more preferably over the entire region of basepair no. 15000 to basepair no. 30000 of SEQ ID NO: 1.

In another embodiment the methylation degree is determined in the region of basepair no. 30000 to basepair no. 45000 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 30000 to basepair no. 45000 of SEQ ID NO: 1, more preferably over the entire region of basepair no. 30000 to basepair no. 45000 of SEQ ID NO: 1.

In yet another embodiment the methylation degree is determined in the region of basepair no. 45000 to basepair no. 60000 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 45000 to base pair no. 60000 of SEQ ID NO: 1, more preferably over the entire region of basepair no. 45000 to basepair no. 60000 of SEQ ID NO: 1.

In another embodiment the methylation degree is determined in the region of basepair no. 60000 to basepair no. 75000 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of base pair no. 60000 to basepair no. 75000 of SEQ ID NO: 1, more preferably over the entire region of basepair no. 60000 to basepair no. 75000 of SEQ ID NO: 1.

In another embodiment the methylation degree is determined in the region of basepair no. 75000 to basepair no. 90487 of SEQ ID NO: 1, preferably the methylation degree is determined over a stretch of in the range of 100 to 1000 consecutive basepairs, for example in the range of 100 to 500 consecutive basepairs, such as in the range of 100 to 200 consecutive basepairs within the region of base pair no. 75000 to basepair no. 90487 of SEQ ID NO: 1, more preferably over the entire region of basepair no. 75000 to basepair no. 90487 of SEQ ID NO: 1.

In one preferred embodiment the methylation degree is determined over a sequence of basepair no. 4000 to basepair no. 6000 of SEQ ID NO:1, or a sequence which is at least 90% identical to basepair no. 4000 to basepair no. 6000 of SEQ ID NO:1. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 4000 to basepair no. 6000 of SEQ ID NO: 1, more preferably over the entire region of basepair no. 4000 to basepair no. 6000 of SEQ ID NO: 1

In another preferred embodiment the methylation degree is determined over a sequence of at the most 800 basepairs, preferably at the most 500 basepairs comprising basepair no. 4907 to basepair no. 5374 of SEQ ID NO:1, or a sequence which is at least 90% identical to basepair no. 4907 to basepair no. 5374 of SEQ ID NO:1. Yet more preferably the methylation degree is determined over the stretch of basepair no. 4907 to basepair no. 5374 of SEQ ID NO:1, or a sequence which is at least 90% identical to basepair no. 4907 to basepair no. 5374 of SEQ ID NO:1.

In one preferred embodiment the methylation degree is determined over a part of the AOX1 gene comprising at least basepair no. 4907 to basepair no. 5374 of SEQ ID NO:1, or a sequence which is at least 90% identical to basepair no. 4907 to basepair no. 5374 of SEQ ID NO: 1. In a particular embodiment the methylation degree is determined in at least a part of a region of the AOX1 gene comprising basepair no. 4907 to basepair no. 5374 of SEQ ID NO: 1, or a sequence which is at least 90% identical to basepair no. 4907 to basepair no. 5374 of SEQ ID NO:1.

In one embodiment the methylation degree is determined over the entire C1orf114 gene according to SEQ ID NO:2.

In another embodiment the methylation degree is determined over a stretch of 10 to 37000 consecutive basepairs, such as for example of 10 to 30000 consecutive basepairs, such as of 10 to 10000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the C1orf114 gene according to SEQ ID NO:2.

In another embodiment the methylation degree is determined over a stretch of 100 to 1000 consecutive basepairs, such as for example of 100 to 800 consecutive basepairs, such as of 100 to 600 consecutive basepairs, such as for example of 100 to 200 consecutive basepairs of the C1orf114 gene according to SEQ ID NO:2.

In one preferred embodiment the methylation degree is determined over a stretch of 100 to 500 consecutive base pairs of the C1orf114 gene according to SEQ ID NO:2.

In one embodiment the methylation degree is determined in the region of basepair no. 1 to basepair no. 20000 of SEQ ID NO: 2, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 20000 of SEQ ID NO: 2, more preferably over the entire region of base pair no. 1 to base pair no. 20000 of SEQ ID NO: 2.

In another embodiment the methylation degree is determined in the region of base pair no. 20000 to base pair no. 37557 of SEQ ID NO: 2, preferably the methylation degree is determined over a stretch of in the range of 100 to 1000 consecutive bp, for example in the range of 100 to 500 consecutive bp, such as in the range of 100 to 200 consecutive bp within the region of basepair no. 20000 to basepair no. 37557 of SEQ ID NO: 2, more preferably over the entire region of basepair no. 20000 to basepair no. 37557 of SEQ ID NO: 2.

In yet another embodiment the methylation degree is determined in the region of basepair no. 1 to basepair no. 10000 of SEQ ID NO: 2, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 10000 of SEQ ID NO: 2, more preferably over the entire region of basepair no. 1 to basepair no. 10000 of SEQ ID NO: 2.

In a further embodiment the methylation degree is determined in the region of basepair no. 10000 to basepair no. 20000 of SEQ ID NO: 2, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 10000 to basepair no. 20000 of SEQ ID NO: 2, more preferably over the entire region of basepair no. 10000 to basepair no. 20000 of SEQ ID NO: 2.

In another embodiment the methylation degree is determined in the region of basepair no. 20000 to basepair no. 30000 of SEQ ID NO: 2, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 20000 to basepair no. 30000 of SEQ ID NO: 2, more preferably over the entire region of basepair no. 20000 to basepair no. 30000 of SEQ ID NO: 2.

In yet another embodiment the methylation degree is determined in the region of basepair no. 30000 to basepair no. 37557 of SEQ ID NO: 2, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 30000 to base pair no. 37557 of SEQ ID NO: 2, more preferably over the entire region of basepair no. 30000 to basepair no. 37557 of SEQ ID NO: 2.

In one preferred embodiment the methylation degree is determined over a sequence of basepair no. 4000 to basepair no. 6000 of SEQ ID NO:2, or a sequence which is at least 90% identical to basepair no. 4000 to basepair no. 6000 of SEQ ID NO:2. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 4000 to basepair no. 6000 of SEQ ID NO: 2, more preferably over the entire region of basepair no. 4000 to basepair no. 6000 of SEQ ID NO: 2.

In another preferred embodiment the methylation degree is determined over a sequence of at the most 800 basepairs, preferably at the most 500 basepairs comprising basepair no. 4777 to basepair no. 5072 of SEQ ID NO:2, or a sequence which is at least 90% identical to basepair no. 4777 to basepair no. 5072 of SEQ ID NO:2. Yet more preferably the methylation degree is determined over the stretch of basepair no. 4777 to basepair no. 5072 of SEQ ID NO:2, or a sequence which is at least 90% identical to basepair no. 4777 to basepair no. 5072 of SEQ ID NO:2.

In one preferred embodiment the methylation degree is determined over a part of the C1orf114 gene comprising at least basepair no. 4777 to basepair no. 5072 of SEQ ID NO:2, or a sequence which is at least 90% identical to basepair no. 4777 to basepair no. 5072 of SEQ ID NO:2. In a particular embodiment the methylation degree is determined in at least a part of a region of the C1orf114 gene comprising basepair no. 4777 to basepair no. 5072 of SEQ ID NO:2, or a sequence which is at least 90% identical to basepair no. 4777 to basepair no. 5072 of SEQ ID NO:2.

In one embodiment the methylation degree is determined over the entire GAS6 gene according to SEQ ID NO:3.

In another embodiment the methylation degree is determined over a stretch of 10 to 48000 consecutive basepairs, such as for example of 10 to 40000 consecutive basepairs, such as of 10 to 30000 consecutive basepairs, such as for example of 10 to 20000 consecutive basepairs, such as of 10 to 10000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the GAS6 gene according to SEQ ID NO:3.

In another embodiment the methylation degree is determined over a stretch of 100 to 1000 consecutive basepairs, such as for example of 100 to 800 consecutive basepairs, such as of 100 to 600 consecutive basepairs, such as for example of 100 to 200 consecutive basepairs of the GAS6 gene according to SEQ ID NO:3.

In one preferred embodiment the methylation degree is determined over a stretch of 100 to 500 consecutive base pairs of the GAS6 gene according to SEQ ID NO:3.

In one embodiment the methylation degree is determined in the region of basepair no. 1 to basepair no. 25000 of SEQ ID NO:3, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 25000 of SEQ ID NO: 3, more preferably over the entire region of base pair no. 1 to base pair no. 25000 of SEQ ID NO: 3.

In another embodiment the methylation degree is determined in the region of base pair no. 25000 to base pair no. 48525 of SEQ ID NO: 3, preferably the methylation degree is determined over a stretch of in the range of 100 to 1000 consecutive bp, for example in the range of 100 to 500 consecutive bp, such as in the range of 100 to 200 consecutive bp within the region of basepair no. 25000 to basepair no. 48525 of SEQ ID NO: 3, more preferably over the entire region of basepair no. 25000 to basepair no. 48525 of SEQ ID NO: 3.

In yet another embodiment the methylation degree is determined in the region of basepair no. 1 to basepair no. 10000 of SEQ ID NO: 3, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 10000 of SEQ ID NO: 3, more preferably over the entire region of basepair no. 1 to basepair no. 10000 of SEQ ID NO: 3.

In a further embodiment the methylation degree is determined in the region of basepair no. 10000 to basepair no.

20000 of SEQ ID NO: 3, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 10000 to basepair no. 20000 of SEQ ID NO: 3, more preferably over the entire region of basepair no. 10000 to basepair no. 20000 of SEQ ID NO: 3.

In another embodiment the methylation degree is determined in the region of basepair no. 20000 to basepair no. 30000 of SEQ ID NO: 3, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 20000 to basepair no. 30000 of SEQ ID NO: 3, more preferably over the entire region of basepair no. 20000 to basepair no. 30000 of SEQ ID NO: 3.

In yet another embodiment the methylation degree is determined in the region of basepair no. 30000 to basepair no. 40000 of SEQ ID NO: 3, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 30000 to base pair no. 40000 of SEQ ID NO: 3, more preferably over the entire region of basepair no. 30000 to basepair no. 40000 of SEQ ID NO: 3.

In another embodiment the methylation degree is determined in the region of basepair no. 40000 to basepair no. 48525 of SEQ ID NO: 3, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 40000 to base pair no. 48525 of SEQ ID NO: 3, more preferably over the entire region of basepair no. 40000 to basepair no. 48525 of SEQ ID NO: 3.

In one preferred embodiment the methylation degree is determined over a sequence of basepair no. 5000 to basepair no. 7000 of SEQ ID NO:3, or a sequence which is at least 90% identical to basepair no. 5000 to basepair no. 7000 of SEQ ID NO:3. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 5000 to basepair no. 7000 of SEQ ID NO: 3, more preferably over the entire region of basepair no. 5000 to basepair no. 7000 of SEQ ID NO: 3.

In another preferred embodiment the methylation degree is determined over a sequence of at the most 800 basepairs, preferably at the most 500 basepairs comprising basepair no. 5948 to basepair no. 6265 of SEQ ID NO:3, or a sequence which is at least 90% identical to basepair no. 5948 to basepair no. 6265 of SEQ ID NO:3. Yet more preferably the methylation degree is determined over the stretch of basepair no. 5948 to basepair no. 6265 of SEQ ID NO:2, or a sequence which is at least 90% identical to basepair no. 5948 to basepair no. 6265 of SEQ ID NO:3.

In one preferred embodiment the methylation degree is determined over a part of the GAS6 gene comprising at least basepair no. 5948 to basepair no. 6265 of SEQ ID NO:3, or a sequence which is at least 90% identical to basepair no. 5948 to basepair no. 6265 of SEQ ID NO:3. In a particular embodiment the methylation degree is determined in at least a part of a region of the GAS6 gene comprising basepair no. 5948 to basepair no. 6265 of SEQ ID NO:3, or a sequence which is at least 90% identical to basepair no. 5948 to basepair no. 6265 of SEQ ID NO:3.

In one embodiment the methylation degree is determined over the entire HAPLN3 gene according to SEQ ID NO:4.

In another embodiment the methylation degree is determined over a stretch of 10 to 23000 consecutive basepairs, such as for example of 10 to 15000 consecutive basepairs, such as of 10 to 10000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the C1orf114 gene according to SEQ ID NO:4.

In another embodiment the methylation degree is determined over a stretch of 100 to 1000 consecutive basepairs, such as for example of 100 to 800 consecutive basepairs, such as of 100 to 500 consecutive basepairs, such as for example of 100 to 200 consecutive basepairs of the HAPLN3 gene according to SEQ ID NO:4.

In one preferred embodiment the methylation degree is determined over a stretch of 100 to 600 consecutive base pairs of the HAPLN3 gene according to SEQ ID NO:4.

In one embodiment the methylation degree is determined in the region of basepair no. 1 to basepair no. 10000 of SEQ ID NO: 4, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 10000 of SEQ ID NO: 4, more preferably over the entire region of base pair no. 1 to base pair no. 10000 of SEQ ID NO: 4.

In another embodiment the methylation degree is determined in the region of base pair no. 10000 to base pair no. 23252 of SEQ ID NO: 4, preferably the methylation degree is determined over a stretch of in the range of 100 to 1000 consecutive bp, for example in the range of 100 to 500 consecutive bp, such as in the range of 100 to 200 consecutive bp within the region of basepair no. 10000 to basepair no. 23252 of SEQ ID NO: 4, more preferably over the entire region of basepair no. 10000 to basepair no. 23252 of SEQ ID NO: 4.

In yet another embodiment the methylation degree is determined in the region of basepair no. 1 to basepair no. 6000 of SEQ ID NO: 4, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 6000 of SEQ ID NO: 4, more preferably over the entire region of basepair no. 1 to basepair no. 6000 of SEQ ID NO: 4.

In a further embodiment the methylation degree is determined in the region of basepair no. 6000 to basepair no. 12000 of SEQ ID NO: 4, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 6000 to basepair no. 12000 of SEQ ID NO: 4, more preferably over the entire region of basepair no. 6000 to basepair no. 12000 of SEQ ID NO: 4.

In another embodiment the methylation degree is determined in the region of basepair no. 12000 to basepair no. 18000 of SEQ ID NO: 4, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 12000 to basepair no. 18000 of SEQ ID NO: 4, more preferably over the entire region of basepair no. 12000 to basepair no. 18000 of SEQ ID NO: 4.

In yet another embodiment the methylation degree is determined in the region of basepair no. 18000 to basepair no. 23252 of SEQ ID NO: 4, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 18000 to base pair no. 23252 of SEQ ID NO: 4, more preferably over the entire region of basepair no. 18000 to basepair no. 23252 of SEQ ID NO: 4.

In one preferred embodiment the methylation degree is determined over a sequence of basepair no. 4000 to basepair no. 6000 of SEQ ID NO:4, or a sequence which is at least 90% identical to basepair no. 4000 to basepair no. 6000 of SEQ ID NO:4. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 4000 to basepair no. 6000 of SEQ ID NO: 4, more preferably over the entire region of basepair no. 4000 to basepair no. 6000 of SEQ ID NO: 4.

In another preferred embodiment the methylation degree is determined over a sequence of at the most 800 basepairs, preferably at the most 500 basepairs comprising basepair no. 4896 to basepair no. 5402 of SEQ ID NO:4, or a sequence which is at least 90% identical to basepair no. 4896 to basepair no. 5402 of SEQ ID NO:4. Yet more preferably the methylation degree is determined over the stretch of basepair no. 4896 to basepair no. 5402 of SEQ ID NO:4, or a sequence which is at least 90% identical to basepair no. 4896 to basepair no. 5402 of SEQ ID NO:4.

In one preferred embodiment the methylation degree is determined over a part of the HAPLN3 gene comprising at least basepair no. 4896 to basepair no. 5402 of SEQ ID NO:4, or a sequence which is at least 90% identical to basepair no. 4896 to basepair no. 5402 of SEQ ID NO:4. In a particular embodiment the methylation degree is determined in at least a part of a region of the HAPLN3 gene comprising basepair no. 4896 to basepair no. 5402 of SEQ ID NO:4, or a sequence which is at least 90% identical to basepair no. 4896 to basepair no. 5402 of SEQ ID NO:4.

In one embodiment the methylation degree is determined over the entire ST6GALNAC3 gene according to SEQ ID NO:5.

In another embodiment the methylation degree is determined over a stretch of 10 to 1,122,000 consecutive basepairs, such as of consecutive 10 to 700,000 basepairs such as for example of 10 to 400,000 consecutive basepairs, such as of 10 to 100,000 consecutive basepairs, such as 50.000 consecutive basepairs, such as for example of 10 to 10000 consecutive basepairs, such as of 10 to 7000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the ST6GALNAC3 gene according to SEQ ID NO:5.

In another embodiment the methylation degree is determined over a stretch of 100 to 1000 consecutive basepairs, such as for example of 100 to 800 consecutive basepairs, such as of 100 to 600 consecutive basepairs, such as for example of 100 to 200 consecutive basepairs of the ST6GALNAC3 gene according to SEQ ID NO:5.

In one preferred embodiment the methylation degree is determined over a stretch of 100 to 500 consecutive base pairs of the ST6GALNAC3 gene according to SEQ ID NO:5.

In one embodiment the methylation degree is determined in the region of basepair no. 1 to basepair no. 500,000 of SEQ ID NO: 5, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 500,000 of SEQ ID NO: 5, more preferably over the entire region of base pair no. 1 to base pair no. 45000 of SEQ ID NO: 5.

In another embodiment the methylation degree is determined in the region of base pair no. 500,000 to base pair no. 1,122,510 of SEQ ID NO: 1, preferably the methylation degree is determined over a stretch of in the range of 100 to 1000 consecutive bp, for example in the range of 100 to 500 consecutive bp, such as in the range of 100 to 200 consecutive bp within the region of basepair no. 500,000 to basepair no. 1,122,510 of SEQ ID NO: 5, more preferably over the entire region of basepair no. 500,000 to basepair no. 1,122,510 of SEQ ID NO: 5.

In yet another embodiment the methylation degree is determined in the region of basepair no. 1 to basepair no. 10000 of SEQ ID NO: 5, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 10000 of SEQ ID NO: 5, more preferably over the entire region of basepair no. 1 to basepair no. 10000 of SEQ ID NO: 5.

In a further embodiment the methylation degree is determined in the region of basepair no. 10000 to basepair no. 100,000 of SEQ ID NO: 5, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 10000 to basepair no. 100,000 of SEQ ID NO: 5, more preferably over the entire region of basepair no. 10000 to basepair no. 100,000 of SEQ ID NO: 5.

In another embodiment the methylation degree is determined in the region of basepair no. 200,000 to basepair no. 400,000 of SEQ ID NO: 5, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 200,000 to basepair no. 400,000 of SEQ ID NO: 5, more preferably over the entire region of basepair no. 200,000 to basepair no. 400,000 of SEQ ID NO: 5.

In yet another embodiment the methylation degree is determined in the region of basepair no. 400,000 to basepair no. 700,000 of SEQ ID NO: 5, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 400,000 to basepair no. 700,000 of SEQ ID NO: 5, more preferably over the entire region of basepair no. 400,000 to basepair no. 700,000 of SEQ ID NO: 5.

In another embodiment the methylation degree is determined in the region of basepair no. 700,000 to basepair no. 1,122,510 of SEQ ID NO: 5, preferably the methylation degree is determined over a stretch of in the range of 100 to 1000 consecutive basepairs, for example in the range of 100 to 500 consecutive basepairs, such as in the range of 100 to 200 consecutive basepairs within the region of base pair no. 700,000 to basepair no. 1,122,510 of SEQ ID NO: 5, more preferably over the entire region of basepair no. 700,000 to basepair no. 1,122,510 of SEQ ID NO: 5.

In one preferred embodiment the methylation degree is determined over a sequence of basepair no. 4000 to basepair no. 6000 of SEQ ID NO:5, or a sequence which is at least 90% identical to basepair no. 4000 to basepair no. 6000 of SEQ ID NO:1. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 4000 to basepair no. 6000 of SEQ ID NO: 5, more preferably over the entire region of basepair no. 4000 to basepair no. 6000 of SEQ ID NO: 5

In another preferred embodiment the methylation degree is determined over a sequence of at the most 800 basepairs, preferably at the most 500 basepairs comprising basepair no. 5097 to basepair no. 5186 of SEQ ID NO:5, or a sequence which is at least 90% identical to basepair no. 5097 to basepair no. 5186 of SEQ ID NO:5. Yet more preferably the methylation degree is determined over the stretch of basepair no. 5097 to basepair no. 5186 of SEQ ID NO:5, or a sequence which is at least 90% identical to basepair no. 5097 to basepair no. 5186 of SEQ ID NO:5.

In one preferred embodiment the methylation degree is determined over a part of the ST6GALNAC3 gene comprising at least basepair no. 5097 to basepair no. 5186 of SEQ ID NO:5, or a sequence which is at least 90% identical to basepair no. 5097 to basepair no. 5186 of SEQ ID NO:5. In a particular embodiment the methylation degree is determined in at least a part of a region of the ST6GALNAC3 gene comprising basepair no. 5097 to basepair no. 5186 of SEQ ID NO:5, or a sequence which is at least 90% identical to basepair no. 5097 to basepair no. 5186 of SEQ ID NO:5.

In one embodiment the methylation degree is determined over the entire ZNF660 gene according to SEQ ID NO:6.

In another embodiment the methylation degree is determined over a stretch of 10 to 16000 consecutive basepairs, such as for example of 10 to 13000 consecutive basepairs, such as of 10 to 10000 consecutive basepairs, such as for example of 10 to 7000 consecutive basepairs, such as of 10 to 5000 consecutive basepairs, such as of 10 to 4000 consecutive basepairs, such as of 10 to 3000 consecutive basepairs, such as for example of 10 to 2000 consecutive basepairs, such as of 10 to 1000 consecutive basepairs, such as for example of 10 to 500 consecutive basepairs, such as of 10 to 400 consecutive basepairs, such as of 10 to 300 consecutive basepairs, such as for example of 10 to 200 consecutive basepairs, such as of 10 to 100 consecutive basepairs, of the ZNF660 gene according to SEQ ID NO:6.

In another embodiment the methylation degree is determined over a stretch of 100 to 1000 consecutive basepairs, such as for example of 100 to 800 consecutive basepairs, such as of 100 to 600 consecutive basepairs, such as for example of 100 to 200 consecutive basepairs of the ZNF660 gene according to SEQ ID NO:6.

In one preferred embodiment the methylation degree is determined over a stretch of 100 to 500 consecutive base pairs of the ZNF660 gene according to SEQ ID NO:6.

In one embodiment the methylation degree is determined in the region of basepair no. 1 to basepair no. 8000 of SEQ ID NO: 6, preferably the methylation degree is determined over a stretch of in the range of 100 to 1000 consecutive bp, for example in the range of 100 to 500 consecutive bp, such as in the range of 100 to 200 consecutive bp within the region of base pair no. 1 to base pair no. 8000 of SEQ ID NO: 6, more preferably over the entire region of base pair no. 1 to base pair no. 8000 of SEQ ID NO: 6.

In another embodiment the methylation degree is determined in the region of base pair no. 8000 to base pair no. 16102 of SEQ ID NO: 6, preferably the methylation degree is determined over a stretch of in the range of 100 to 1000 consecutive bp, for example in the range of 100 to 500 consecutive bp, such as in the range of 100 to 200 consecutive bp within the region of basepair no. 8000 to base pair no. 16102 of SEQ ID NO: 6, more preferably over the entire region of basepair no. 8000 to base pair no. 16102 of SEQ ID NO: 6.

In yet another embodiment the methylation degree is determined in the region of basepair no. 1 to basepair no. 4000 of SEQ ID NO: 6, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 1 to basepair no. 4000 of SEQ ID NO: 6, more preferably over the entire region of basepair no. 1 to basepair no. 4000 of SEQ ID NO: 6.

In a further embodiment the methylation degree is determined in the region of basepair no. 4000 to basepair no. 8000 of SEQ ID NO: 6, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 4000 to basepair no. 8000 of SEQ ID NO: 6, more preferably over the entire region of basepair no. 4000 to basepair no. 8000 of SEQ ID NO: 6.

In another embodiment the methylation degree is determined in the region of basepair no. 8000 to basepair no. 12000 of SEQ ID NO: 6, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 8000 to basepair no. 12000 of SEQ ID NO: 6, more preferably over the entire region of basepair no. 8000 to basepair no. 12000 of SEQ ID NO: 6.

In yet another embodiment the methylation degree is determined in the region of basepair no. 12000 to basepair no. 16102 of SEQ ID NO: 6, preferably the methylation degree is determined over a stretch of in the range of 100 to 1000 consecutive basepairs, for example in the range of 100 to 500 consecutive basepairs, such as in the range of 100 to 200 consecutive basepairs within the region of basepair no. 12000 to basepair no. 16102 of SEQ ID NO: 6, more preferably over the entire region of basepair no. 12000 to basepair no. 16102 of SEQ ID NO: 6.

In one preferred embodiment the methylation degree is determined over a sequence of basepair no. 4000 to basepair no. 6000 of SEQ ID NO:6, or a sequence which is at least 90% identical to basepair no. 4000 to basepair no. 6000 of SEQ ID NO:6. It is also preferred that the methylation degree is determined over a stretch of in the range of 100 to 1000 consecutive basepairs, for example in the range of 100 to 500 consecutive basepairs, such as in the range of 100 to 200 consecutive basepairs within the region of base pair no. 4000 to basepair no. 6000 of SEQ ID NO: 6, more preferably over the entire region of basepair no. 4000 to basepair no. 6000 of SEQ ID NO: 6.

In another preferred embodiment the methylation degree is determined over a sequence of at the most 800 basepairs, preferably at the most 500 basepairs comprising basepair no. 4923 to basepair no. 5225 of SEQ ID NO:6, or a sequence which is at least 90% identical to basepair no. 4923 to basepair no. 5225 of SEQ ID NO:6. Yet more preferably the methylation degree is determined over the stretch of basepair no. 4923 to basepair no. 5225 of SEQ ID NO:6, or a sequence which is at least 90% identical to basepair no. 4923 to basepair no. 5225 of SEQ ID NO:6.

In one preferred embodiment the methylation degree is determined over a part of the ZNF660 gene comprising at least basepair no. 4923 to basepair no. 5225 of SEQ ID NO:6, or a sequence which is at least 90% identical to basepair no. 4923 to basepair no. 5225 of SEQ ID NO:6. In a particular embodiment the methylation degree is determined in at least a part of a region of the ZNF660 gene comprising basepair no. 4923 to basepair no. 5225 of SEQ ID NO:6, or a sequence which is at least 90% identical to basepair no. 4923 to basepair no. 5225 of SEQ ID NO:6.

It is appreciated that the methylation degree of at least one CpG dinucleotide of SEQ ID NO:1, SEQ ID NO:2, SEQ ID NO:3, SEQ ID NO:4, SEQ ID NO:5 and/or SEQ ID NO:6 is determined, such as two, three, four, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95 or more than 100 CpG dinucleotides.

A methylation degree in a sample increased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more, relative to previous measurements on the same individual, or to measurements on non-diseased tissue from the same individual, or relative to a standard level, is considered an increased methylation degree according to the present invention. Thus, as aforementioned, an increased methylation degree of the AOX1, C1orf114, GAS6, HAPLN3, ST6GALNAC3 and/or ZNF660 gene is indicative of the presence of prostate cancer.

A methylation degree in a sample increased by at least 1.5-fold or for example at least 2-fold, 3-fold, 5-fold, 10-fold or even more, relative to previous measurements on the same individual, or to measurements on non-diseased tissue from the same individual, or relative to a standard level, is considered an increased methylation degree according to the present invention. Thus, as aforementioned, an increased methylation degree of the AOX1, C1orf114, GAS6, HAPLN3, ST6GALNAC3 and/or ZNF660 gene is indicative of the presence of prostate cancer.

In one embodiment the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 1%, such as for example 5%, such as 10%, such as for example 15%, such as 20%, such as for example 35%, such as 40%, such as for example 45%, such as 50%.

In one preferred embodiment the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 15% such as for example 16%, such as 17%, such as for example 18%, such as 19%, when said sample is a tissue sample.

In another preferred embodiment the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 21% such as for example 22%, such as 23%, such as for example 24%, such as 25%, when said sample is a tissue sample.

In a more preferred embodiment the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 20%.

In a more preferred embodiment the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is considered to be increased and indicative of the presence of prostate cancer when said methylation degree is determined to be above 20%, when said sample is a tissue sample.

In a specific embodiment the tissue sample is a prostate tissue sample.

An increased methylation degree is exemplified in FIG. 1 where AOX1, C1orf114, GAS6, HAPLN3, ST6GALNAC3 and ZNF660 in the localized PC (RP) and metastatic PC (MPC) clinical tissue samples display increased methylation. Similarly, a decreased methylation degree is exemplified in FIG. 1 where AOX1, C1orf114, GAS6, HAPLN3, ST6GALNAC3 and ZNF660 in adjacent normal (ADJ-N) and benign prostatic hyperplasia (BPH) clinical tissue samples display decreased methylation.

In one embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 0.001%, such as for example 0.01%, such as 0.05%, such as for example 0.1%, such as 0.5%, such as for example 1%, such as 2%, such as for example 3%, such as 4%, such as for example 5%, such as 6%, such as for example 8%, such as 10%, such as for example 15%, such as 20%, such as for example 25%, such as 30%, such as for example 35%, such as 40%, such as for example 50%, when said sample is a body fluid sample.

The body fluid sample may be selected from the group consisting of urine, blood, plasma, serum and semen.

In one preferred embodiment the body fluid sample is a urine sample.

In one preferred embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation degree is determined to be above 0.01%, when said sample is a body fluid sample.

In one preferred embodiment the body fluid sample is a blood sample. In another preferred embodiment the body fluid sample is a urine sample.

Determining the methylation degree of one or more of the genes described herein in histopathologically negative biopsies may improve the early detection of prostate cancer. A histopathologically negative biopsy is a biopsy or tissue sample, wherein it has been determined by microscopic examination of the tissue that the sample is negative, i.e. the individual from which the sample is taken does not have prostate cancer. The biopsy sample can be a biopsy of the prostate gland or resected prostate tissue.

Thus, in a specific embodiment an increased methylation degree in histopathological cancer-negative biopsies is indicative of cancer-positive repeat biopsies. An increased methylation degree is as defined above.

In one embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be decreased and indicative of the absence of prostate cancer when said methylation degree is determined to be below 30% such as for example 25%, such as 15%, such as for example 10%, or such as 5% or such as for example 1%.

In one preferred embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be decreased and indicative of the absence of prostate cancer when said methylation degree is determined to be below 20%. In a preferred embodiment said sample is a tissue sample.

In another embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be decreased and indicative of the absence of prostate cancer when said methylation degree is determined to be below 10% such as for example 8%, such as 6%, such as for example 4%, such as 2% or such as for example 1% or such as for example 0.5% or such as 0.1%, wherein said sample is a body fluid sample.

The body fluid sample may be selected from the group consisting of urine, blood, plasma, serum and semen. In one preferred embodiment the body fluid sample is a urine sample.

In one preferred embodiment the methylation degree of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is considered to be decreased and indicative of the absence of prostate cancer when said methylation degree is determined to be below 0.1% is indicative of the absence of prostate cancer.

Methylation Incidence

Another method for measuring the methylation level of the AOX1, C1orf114, GAS6, HAPLN3, ST6GALNAC3 and ZNF660 genes is by determining the methylation incidence. The methylation incidence refers to the percentage of DNA molecules in a given sample, wherein all or most of the CpG dinucleotides in a specific region of a gene selected from the group consisting of AOX1, C1orf114, GAS6, HAPLN3, ST6GALNAC3 and ZNF660 are methylated. Methylation of this specific region of said gene will indicate that the gene originates from a cell that is a PC cell. By way of example, if the methylation incidence of the AOX1 gene is 10% in a sample, then 10% of the DNA molecules in said sample have an AOX1 gene which is fully or almost fully methylated in the region tested and consequently at least 10% of the DNA molecules in the sample originate from cells that are prostate cancer cells. Thus, the detection of one methylated AOX1, C1orf114, GAS6, HAPLN3, ST6GALNAC3 and/or ZNF660 gene will indicate the presence of a PC cell.

The methylation incidence may for example be determined using methylation specific PCR (MSP) or Real-time fluorescent MSP (described below). In MSP a primer or a fluorescent probe is typically designed to anneal to a site containing one or more methylated CpGs. Thus, this primer or probe will preferably anneal to a completely methylated target region. MSP is a highly sensitive method, which may detect one methylated gene among 10.000-100,000 unmethylated genes.

It is appreciated that the methylation incidence of at least one CpG dinucleotide of SEQ ID NO:1, SEQ ID NO:2, SEQ ID NO:3, SEQ ID NO:4, SEQ ID NO:5 and/or SEQ ID NO:6 is determined, such as two, three, four, 5, 6, 7, 8, 9 or more than 10 CpG dinucleotides.

The methylation incidence may be determined in same the gene regions as the methylation degrees as defined herein.

In a preferred embodiment the methylation incidence is determined over a part of the AOX1 gene comprising at least basepair no. 4907 to basepair no. 5374 of SEQ ID NO: 1, or a sequence which is at least 90% identical to basepair no. 4907 to basepair no. 5374 of SEQ ID NO:1. In a particular embodiment the methylation incidence is determined in at least a part of a region of the AOX1 gene comprising basepair no. 4907 to basepair no. 5374 of SEQ ID NO:1, or a sequence which is at least 90% identical to basepair no. 4907 to basepair no. 5374 of SEQ ID NO:1.

In another preferred embodiment the methylation incidence is determined over a part of the C1orf114 gene comprising at least basepair no. 4777 to basepair no. 5072 of SEQ ID NO:2, or a sequence which is at least 90% identical to basepair no. 4777 to basepair no. 5072 of SEQ ID NO:2. In a particular embodiment the methylation incidence is determined in at least a part of a region of the C1orf114 gene comprising basepair no. 4777 to basepair no. 5072 of SEQ ID NO:2, or a sequence which is at least 90% identical to basepair no. 4777 to basepair no. 5072 of SEQ ID NO:2.

In yet another preferred embodiment the methylation incidence is determined over a part of the GAS6 gene comprising at least basepair no. 5948 to basepair no. 6265 of SEQ ID NO:3, or a sequence which is at least 90% identical to basepair no. 5948 to basepair no. 6265 of SEQ ID NO:3. In a particular embodiment the methylation incidence is determined in at least a part of a region of the GAS6 gene comprising basepair no. 5948 to basepair no. 6265 of SEQ ID NO:3, or a sequence which is at least 90% identical to basepair no. 5948 to basepair no. 6265 of SEQ ID NO:3.

In a further preferred embodiment the methylation incidence is determined over a part of the HAPLN3 gene comprising at least basepair no. 4896 to basepair no. 5402 of SEQ ID NO:4, or a sequence which is at least 90% identical to basepair no 4896 to basepair no. 5402 of SEQ ID NO:4. In a particular embodiment the methylation incidence is determined in at least a part of a region of the HAPLN3 gene comprising basepair no. 4896 to basepair no. 5402 of SEQ ID NO:4, or a sequence which is at least 90% identical to basepair no 4896 to basepair no. 5402 of SEQ ID NO:4.

In another preferred embodiment the methylation incidence is determined over a part of the ST6GALNAC3 gene comprising at least basepair no. 5097 to basepair no. 5186 of SEQ ID NO:5, or a sequence which is at least 90% identical to basepair no. 5097 to basepair no. 5186 of SEQ ID NO:5. In a particular embodiment the methylation incidence is determined in at least a part of a region of the ST6GALNAC3 gene comprising basepair no. 5097 to basepair no. 5186 of SEQ ID NO:5, or a sequence which is at least 90% identical to basepair no. 5097 to basepair no. 5186 of SEQ ID NO 5

In yet another preferred embodiment the methylation incidence is determined over a part of the ZNF660 gene comprising at least basepair no. 4923 to basepair no. 5225 of SEQ ID NO:6, or a sequence which is at least 90% identical to basepair no. 4923 to basepair no. 5225 of SEQ ID NO:6. In a particular embodiment the methylation incidence is determined in at least a part of a region of the ZNF660 gene comprising basepair no. 4923 to basepair no. 5225 of SEQ ID NO:6, or a sequence which is at least 90% identical to basepair no. 4923 to basepair no. 5225 of SEQ ID NO:6.

An increased methylation incidence of the AOX1, C1orf114, GAS6, HAPLN3, ST6GALNAC3 and/or ZNF660 gene is indicative of the presence of prostate cancer whereas a decreased methylation incidence of the AOX1, C1orf114, GAS6, HAPLN3, ST6GALNAC3 and/or ZNF660 gene is indicative of the absence of prostate cancer A methylation incidence in a sample increased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more, relative to previous measurements on the same individual, or to measurements on non-diseased tissue from the same individual, or relative to a standard level, is considered an increased methylation incidence according to the present invention.

A methylation incidence in a sample increased by at least 1.5-fold or for example at least 2-fold, 3-fold, 5-fold, 10-fold or even more, relative to previous measurements on the same individual, or to measurements on non-diseased tissue from the same individual, or relative to a standard level, is considered an increased methylation degree according to the present invention.

In one embodiment the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is considered to be increased and indicative of the presence of prostate cancer when said methylation incidence is determined to be above 0.0001%, such as for example 0.001%, such as 0.01%, such as for example 0.1%, such as 1%, such as for example 5%, such as 10%, such as for example 15%, such as 20%, such as for example 35%, such as 40%, such as for example 45%, such as 50%.

In one preferred embodiment the methylation incidence of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation incidence is determined to be above 0.1%.

In another preferred embodiment the methylation incidence of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation incidence is determined to be above 0.01%.

In yet another preferred embodiment the methylation incidence of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be increased and indicative of the presence of prostate cancer when said methylation incidence is determined to be above 0.001%.

In yet another preferred embodiment the methylation incidence of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a urine sample is considered to be increased and indicative of the presence of prostate cancer when said methylation incidence is determined to be above 0.1%. In particular, a methylation incidence above 0.1% in a urine sample may indicate the presence of a T2 stage prostate cancer.

Determining the methylation incidence of one or more of the genes described herein in histopathologically negative biopsies may improve the early detection of prostate cancer. A histopathologically negative biopsy is a biopsy or tissue sample, wherein it has been determined by microscopic examination of the tissue that the sample is negative, i.e. the individual from which the sample is taken does not have prostate cancer. The biopsy sample can be a biopsy of the prostate gland or resected prostate tissue.

Thus, in a specific embodiment an increased methylation incidence in histopathological cancer-negative biopsies is indicative of cancer-positive repeat biopsies. An increased methylation incidence is as defined above.

In one preferred embodiment of the present invention a methylation incidence of a
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof
in a sample is considered to be decreased and indicative of the absence of prostate cancer when said methylation incidence is determined to be below 0.001%.

Determining the methylation degree and/or methylation incidence in the methods according to the invention may be done using any suitable method known to the skilled person.

A number of current methodologies for methylation studies are well known to the skilled person. Sequencing of bisulphite-treated DNA is a normal method for methylation studies as it reveals directly the status of each CpG dinucleotide. Thus, in a preferred embodiment of the invention the methylation degree may be determined by sequencing of bisulphite-treated DNA. Bisulphate-based methylation genomic sequencing is capable of detecting every methylated cytosine on both strands of any target sequence, using DNA isolated from fewer than 100 cells, though of course more cells may be employed. In this method, sodium bisulphite is used to convert cytosine residues to uracil residues in single-stranded DNA, under conditions whereby 5-methylcytosine remains non-reactive. The converted DNA is amplified with specific primers and sequenced. All the cytosine residues remaining in the sequence represent previously methylated cytosines in the genome. This method may utilize defined procedures that maximize the efficiency of denaturation, bisulphite conversion and amplification, to permit methylation mapping of single genes from small amounts of genomic DNA.

According to the present invention the methylation incidence may be determined using methylation specific PCR. Methylation specific PCR (MSP) is one of the most widely used assays for the sensitive detection of methylation. U.S. Pat. No. 5,786,146 discloses a method of methylation specific PCR (MSP) for identifying DNA methylation patterns in a CpG containing nucleic acid, which is useful for use with the present invention. The method uses agents to modify unmethylated cytosine in the nucleic acid. Prior to amplification, the DNA is treated with sodium bisulphite to convert all unmethylated cytosines to uracils. The bisulphite reaction effectively converts methylation information into sequence difference. CpG specific oligonucleotide primers are used to distinguish between modified methylated and unmethylated nucleic acid. The identification of the methylated nucleic acid is based on the presence or absence of amplification product resulting from the amplification and distinguishing modified methylated and non-methylated nucleic acids. The generated PCR product can for example be visualized on a gel.

An important parameter for the specificity of methylation-specific PCR is determined by primer design. Since modification of DNA by bisulfite destroys strand complementarity, either strand can serve as the template for subsequent PCR amplification and the methylation pattern of each strand can then be determined. It will be appreciated, though, that amplifying a single strand (e.g. sense strand) is preferable in practice.

Primers are preferably designed to amplify a region that is 80-250 bp in length, which incorporates a sufficient number of cytosines in the original strand to assure that unmodified DNA does not serve as a template for the primers. In addition, the number and position of cytosines within the CpG dinucleotide determines the specificity of the primers for methylated and unmethylated templates. Typically, 1-3 CpG sites are included in each primer and concentrated in the 3' region of each primer. This provides optimal specificity and minimizes false positives due to mispriming. To facilitate simultaneous analysis of each of the primers of a given gene in the same thermocycler, the length of the primers is adjusted to give nearly equal melting/annealing temperatures.

Real-time fluorescent MSP (MethyLight) is based on real time PCR employing fluorescent probes in conjunction with MSP and allows for a homogeneous reaction which is of higher throughput. Thus methylation status according to the methods of the invention may also be determined using real-time fluorescent MSP. If the probe does not contain CpGs, the reaction is essentially a quantitative version of MSP. However, the fluorescent probe is typically designed to anneal to a site containing one or more CpGs, and this third oligonucleotide increases the specificity of the assay for completely methylated target strands. Because the detection of the amplification occurs in real time, there is no need for a secondary electrophoresis step. Since there is no post PCR manipulation of the sample, the risk of contamination is reduced. The MethyLight probe can be of any format including but not limited to a Taqman probe or a LightCycler hybridization probe pair and if multiple reporter dyes are used, several probes can be performed simultaneously. Real-time fluorescent MSP is one preferred method for determining the methylation incidence according to the present invention. Methods such as a PCR-based high-resolution melting analysis assay may, however, also be used to determine the methylation status. Methylation-sensitive high-resolution melting (MS-HRM) analysis is another PCR-based technology which can be used for determination of methylation status according to the invention and for highly specific and highly sensitive detection of methylated genes. This method takes advantage of the fact that methylated DNA and unmethylated DNA acquire different sequences after bisulphite treatment, which results in PCR products with markedly different melting profiles/temperature. PCR is used to amplify both methylated and unmethylated sequences in the same reaction, and this method can be optimised to detect methylation levels as low as 0.1%. MS-HRM also allows estimation of methylation levels by comparison of melting profiles for a test sample to the melting profiles of PCR products derived from standards with known ratios of methylated:unmethylated alleles. MS-HRM analysis protocols are simple and the method is characterized by high reproducibilty (Wojdacz T K, Dobrovic A, Hansen L L. 2008, *Nat Protoc.* 2008; 3(12): 1903-8).

The methylation status can also be measured quantitatively by pyrosequencing of bisulfite converted DNA following PCR amplification. Pyrosequencing is a sequencing-by-synthesis method that relies on the sequential addition and incorporation of nucleotides in a primer-directed polymerase extension. Only one of the four nucleotides is present at any time in the reaction vessel, and only if the added nucleotide is complementary to the template DNA will it be incorporated by a DNA polymerase. This event is monitored in real time and hence can be used to quantitate the ratio between methylated and unmethylated CpG dinucleotides. The pyrosequencing technology makes use of the release of $PP_i$ molecules during the iterative incorporation of unmodified nucleotides that are quantitatively converted into a bioluminometric signal (Tost, J. & Gut, I. G. DNA methylation analysis by pyrosequencing, *Nature Protocols* 2, -2265-2275 (2007)).

In a preferred embodiment the methylation status is determined by targeted resequencing of bisulfite converted DNA (or PCR amplicons hereof) using massively parallel sequencing technologies (next-generation sequencing). This would allow digital quantification of the ratio between methylated and unmethylated CpG dinucleotide(s). Next-generation sequencing platforms are characterized by the ability to process millions of sequence reads in parallel rather than 96 at a time, as typically seen for capillary-based sequencing. The workflow to produce next-generation sequence-ready libraries is straightforward; DNA fragments are prepared for sequencing by ligating specific adaptor oligos to both ends of each DNA fragment. Importantly, relatively little input DNA (a few micrograms at most) is needed to produce a library. Currently available platforms for next-generation sequencing produce shorter read lengths (35-250 bp, depending on the platform), but longer reads will also be possible. (Mardis, E. R. The impact of next-generation sequencing technology on genetics, Trends Genet. 2008 March; 24(3):133-41).

In one embodiment the methylation status is determined using microarrays wherein a specific DNA probe for each CpG site to be studied is used. Thus, a specific DNA probe is used to determine whether a specific CpG site is methylated.

For rapid assessment of CpG methylation density of a DNA region the quantitative methylation density assay may be used as previously described by Galm et al. (2002) Genome Res. 12, 153-7. After bisulfite modification of genomic DNA, the region of interest is PCR amplified with nested primers. PCR products are purified and DNA amount is determined. A predetermined amount of DNA is incubated with $^3$H-SAM (TRK581Bioscience, Amersham) and SssI methyltransferase for methylation quantification. Once reactions are terminated products are purified from the in-vitro methylation mixture. 20% of the eluant volume is counted in $^3$H counter. Normalizing radioactivity DNA of each sample is measured again and the count is normalized to the DNA amount.

Restriction analysis of bisulphite modified DNA is a yet another quantitative technique which can be used to determine DNA methylation levels at specific gene loci in small amounts of genomic DNA. Restriction enzyme digestion is used to reveal methylation-dependent sequence differences in PCR products of sodium bisulfite-treated DNA. Methylation levels in original DNA sample are represented by the relative amounts of digested and undigested PCR product in a linearly quantitative fashion across a wide spectrum of DNA methylation levels. This technique can be reliably applied to DNA obtained from microdissected paraffin-embedded tissue samples.

In another embodiment, differential methylation hybridization (DMH) may be used to determine the methylation status. DMH integrates a high-density, microarray-based screening strategy to detect the presence or absence of methylated CpG dinucleotide genomic fragments. Array-based techniques are used when a number (e.g., >3) of methylation sites in a single region are to be analyzed. First, CpG dinucleotide nucleic acid fragments from a genomic library are generated, amplified and affixed on a solid support to create a CpG dinucleotide rich screening array. Amplicons are generated by digesting DNA from a sample with restriction endonucleases which digest the DNA into fragments but leaves the methylated CpG islands intact. These amplicons are used to probe the CpG dinucleotide rich fragments affixed on the screening array to identify methylation patterns in the CpG dinucleotide rich regions of the DNA sample. Unlike other methylation analysis methods such as Southern hybridization, bisulfite DNA sequencing and methylation-specific PCR which are restricted to analyzing one gene at a time, DMH utilizes numerous CpG dinucleotide rich genomic fragments which may be specifically designed to allow simultaneous analysis of multiple of methylation-associated genes in the genome (for further details see U.S. Pat. No. 6,605,432).

In yet another embodiment, immunoprecipitation of methylated sequences can be used to isolate sequence-specific methylated gene fragments. Briefly, genomic DNA is sonicated to yield fragments of 200-300 bp. The DNA is then denatured, precleaned with a protein A Fast FlowSepharose) and further incubated with a 5-methylcytidine monoclonal antibody. The complex may be purified using protein A Sepharose and subsequently washed. The immunoprecipitated samples are then analyzed using specific PCR primers.

Determining Transcriptional Expression Level

The methods of the present invention comprises a step of determining the transcriptional expression level of at least one
gene selected from the group consisting of AOX1, C1orf114, GAS6, HAPLN3, ST6GALNAC3 and ZNF660, and/or
nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample.

Thus "the transcriptional expression level" as referred to herein is the transcriptional level of at least one
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6.

When the transcriptional expression level of AOX1, C1orf114, GAS6, HAPLN3, ST6GALNAC3 and/or ZNF660 in the sample being tested is below the transcriptional expression level of the corresponding gene in a control sample or a standard value, the transcriptional level of the sample being tested is decreased. Thus, a decrease in the transcriptional expression level is measured relative to the transcriptional expression level of a control sample or a standard value. When for example the transcriptional expression level of the AOX gene in a control sample has a value of 100, and transcriptional expression level of the AOX1 gene in a test sample has a value of 25, the transcriptional expression level is said to be decreased by 75%.

The control sample may be an RNA sample from one healthy male without clinically diagnosed prostate cancer or a pool of RNA samples from more than one healthy male without clinically diagnosed prostate cancer. The control sample may also be an RNA sample from the same person being tested, wherein said control sample has been taken at an earlier time point in the course of disease or before diagnosing the disease. The control sample may also be derived from healthy tissue of the person being tested. The control sample is preferably taken from the same source, such as for example urine, tissue or blood, as the sample to be tested and the control sample is analysed along with the test sample.

In a particular preferred embodiment a decreased transcriptional expression level of at least one
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is indicative of the presence of prostate cancer.

In one embodiment of the present invention a transcriptional level being decreased by at least 10%, or for example at least 15%, 20%, 25%, 30%, 35%, 40%, 45%, 50%, 55%, 60%, 65%, 70% or at least 75% and even more relative to previous measurements on the same individual, or to measurements on non-diseased tissue from the same individual, or relative to a standard level, is indicative of the presence of prostate cancer.

In another embodiment a transcriptional level being decreased by at least 2 fold or more, such as at least 3-fold, at least 4-fold, at least 5-fold or more relative to previous measurements on the same individual, or to measurements on non-diseased tissue from the same individual, or relative to a standard level, is indicative of prostate cancer.

In one preferred embodiment of the present invention a transcriptional level being decreased by at least 45%, or for example at least 46%, 47%, 48%, 49%, 50%, 51%, 52%, 53%, 54%, 55%, 56%, 57%, 58%, 59% or at least 60% and even more relative to previous measurements on the same individual, or to measurements on non-diseased tissue from the same individual, or relative to a standard level, is indicative of the presence of prostate cancer.

In a more preferred embodiment the transcriptional expression level of at least one:
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
of a nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is indicative of the presence of prostate cancer when said transcriptional expression level is decreased by at least 50%.

In a particular embodiment the transcriptional expression level of at least one:

i) gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or ii) nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample is decreased 50% in comparison with the transcriptional level of a control sample.

Transcriptional expression levels of genes may in general be determined by detecting mRNA from the cells or sample of interest. Thus, in the present invention the transcriptional expression levels of the AOX1, C1orf114, GAS6, HAPLN3, ST6GALNAC3 and/or ZNF660 genes may be determined by detecting AOX1 mRNA (SEQ ID NO:7), C1orf114 mRNA (SEQ ID NO:8), GAS6 mRNA (SEQ ID NO:9), HAPLN3 mRNA (SEQ ID NO:10), ST6GALNAC3 mRNA (SEQ ID NO:11) and/or ZNF660 mRNA (SEQ ID NO:12) and/or an mRNA sequence having at least 90% sequence identity with a nucleotide sequence selected from the group consisting of SEQ ID NO:7, SEQ ID NO:8, SEQ ID NO:9, SEQ ID NO:10, SEQ ID NO:11 and SEQ ID NO:12. Transcriptional expression products, such as mRNA may be detected by any suitable technique known to the person skilled in the art.

Determining Transcriptional Levels by PCR-Based Methods

Polymerase Chain Reaction (PCR) is a well-known and well established technique to determine transcriptional products and therefore also a method that in one embodiment is used to determine the transcriptional expression level of the AOX1, C1orf114, GAS6, HAPLN3, ST6GALNAC3 and/or ZNF660 genes, or part thereof according to the invention.

Reverse transcription polymerase chain reaction (RT-PCR) is a variant of polymerase chain reaction (PCR). In RT-PCR an RNA strand is first reverse transcribed into its DNA complement (complementary DNA, or cDNA) using the enzyme reverse transcriptase, and the resulting cDNA is amplified using traditional PCR.

In one preferred embodiment the transcriptional expression level is determined by RT-PCR.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. The high density array may then include probes specific to the internal standard for quantification of the amplified nucleic acid.

Thus, in one embodiment, this invention provides for a method of optimizing a probe set for detection of a particular gene. Generally, this method involves providing a high density array containing a multiplicity of probes of one or more particular length(s) that are complementary to subsequences of the mRNA transcribed by the target gene. In one embodiment the high density array may contain every probe of a particular length that is complementary to a particular mRNA. The probes of the high density array are then hybridized with their target nucleic acid alone and then hybridized with a high complexity, high concentration nucleic acid sample that does not contain the targets complementary to the probes. Thus, for example, where the target nucleic acid is an RNA, the probes are first hybridized with their target nucleic acid alone and then hybridized with RNA made from a cDNA library where the sense of the hybridized RNA is opposite that of the target nucleic acid (to insure that the high complexity sample does not contain targets for the probes). Those probes that show a strong hybridization signal with their target and little or no cross-hybridization with the high complexity sample are preferred probes for use in the high density arrays of this invention.

In addition to PCR and IVT reactions, the methods of the present invention are also applicable to a number of other reaction types, e.g., reverse transcription, nick translation, and the like.

The nucleic acids in a sample will generally be labelled to facilitate detection in subsequent steps. Labelling may be carried out during the amplification, in vitro transcription or nick translation processes. In particular, amplification, in vitro transcription or nick translation may incorporate a label into the amplified or transcribed sequence, either through the use of labelled primers or the incorporation of labelled dNTPs into the amplified sequence.

Hybridization between the sample nucleic acid and the oligonucleotide probes upon the array is then detected, using, e.g., epifluorescence confocal microscopy. Typically, sample is mixed during hybridization to enhance hybridization of nucleic acids in the sample to nucleic acid probes on the array.

In some cases, hybridized oligonucleotides may be labelled following hybridization. For example, where biotin labeled dNTPs are used in, e.g. amplification or transcription, streptavidin linked reporter groups may be used to label hybridized complexes. Such operations can readily be integrated into the systems of the present invention. Alternatively, the nucleic acids in the sample may be labelled following amplification. Post amplification labelling typically involves the covalent attachment of a particular detectable group upon the amplified sequences. Suitable labels or detectable groups include a variety of fluorescent or radioactive labelling groups well known in the art. These labels may also be coupled to the sequences using methods that are well known in the art.

Methods for detection of AOX1, C1orf114, GAS6, HAPLN3, ST6GALNAC3 and/or ZNF660 transcript or part thereof depend upon the label selected. A fluorescent label is preferred because of its extreme sensitivity and simplicity. Standard labelling procedures are used to determine the positions where interactions between a sequence and a reagent take place. For example, if a target sequence is labelled and exposed to a matrix of different probes, only those locations where probes do interact with the target will exhibit any signal. Alternatively, other methods may be used to scan the matrix to determine where interaction takes place. Of course, the spectrum of interactions may be determined in a temporal manner by repeated scans of interactions which occur at each of a multiplicity of conditions. However, instead of testing each individual interaction separately, a multiplicity of sequence interactions may be simultaneously determined on a matrix.

Means of detecting labelled nucleic acids hybridized to the probes of the high density array are known to those of skill in the art. Thus, for example, where a colorimetric label is used, simple visualization of the label is sufficient. Where a radioactive labelled probe is used, detection of the radiation (e.g with photographic film or a solid state detector) is sufficient.

In a preferred embodiment, however, the target nucleic acids are labelled with a fluorescent label and the localization of the label on the probe array is accomplished with fluorescent microscopy. The hybridized array is excited with a light source at the excitation wavelength of the particular fluorescent label and the resulting fluorescence at the emission wavelength is detected. In a preferred embodiment, the excitation light source is a laser appropriate for the excitation of the fluorescent label.

The target polynucleotide may be labelled by any of a number of convenient detectable markers. A fluorescent label is preferred because it provides a very strong signal with low background. It is also optically detectable at high resolution and sensitivity through a quick scanning procedure. Other potential labelling moieties include, radioisotopes, chemiluminescent compounds, labelled binding proteins, heavy metal atoms, spectroscopic markers, magnetic labels, and linked enzymes.

Another method for labelling may bypass any label of the target sequence. The target may be exposed to the probes, and a double strand hybrid is formed at those positions only. Addition of a double strand specific reagent will detect where hybridization takes place. An intercalative dye such as ethidium bromide may be used as long as the probes themselves do not fold back on themselves to a significant extent forming hairpin loops. However, the length of the hairpin loops in short oligonucleotide probes would typically be insufficient to form a stable duplex.

Suitable chromogens will include molecules and compounds which absorb light in a distinctive range of wavelengths so that a color may be observed, or emit light when irradiated with radiation of a particular wave length or wave length range, e.g., fluorescers. Biliproteins, e.g., phycoerythrin, may also serve as labels.

In addition, amplified sequences may be subjected to other post amplification treatments. For example, in some cases, it may be desirable to fragment the sequence prior to hybridization with an oligonucleotide array, in order to provide segments which are more readily accessible to the probes, which avoid looping and/or hybridization to multiple probes. Fragmentation of the nucleic acids may generally be carried out by physical, chemical or enzymatic methods that are known in the art.

Following the various sample preparation operations, the sample will generally be subjected to one or more analysis operations. Particularly preferred analysis operations include, e.g. sequence based analyses using an oligonucleotide array and/or size based analyses using, e.g. microcapillary array electrophoresis.

Microcapillary array electrophoresis generally involves the use of a thin capillary or channel which may or may not be filled with a particular separation medium. Electrophoresis of a sample through the capillary provides a size based separation profile for the sample. Microcapillary array electrophoresis generally provides a rapid method for size based sequencing, PCR product analysis and restriction fragment sizing. The high surface to volume ratio of these capillaries allows for the application of higher electric fields across the capillary without substantial thermal variation across the capillary, consequently allowing for more rapid separations. Furthermore, when combined with confocal imaging methods these methods provide sensitivity in the range of attomoles, which is comparable to the sensitivity of radioactive sequencing methods.

In some embodiments it may be desirable to provide additional or alternative means for analyzing the nucleic acids from the sample.

Transcriptional expression levels of genes may in general be determined by detecting mRNA from the cells or sample of interest. Thus, in the present invention the transcriptional expression levels of the AOX1, C1orf114, GAS6, HAPLN3, ST6GALNAC3 and/or ZNF660 genes may be determined by detecting AOX1 mRNA (SEQ ID NO:7), C1orf114 mRNA (SEQ ID NO:8), GAS6 mRNA (SEQ ID NO:9), HAPLN3 mRNA (SEQ ID NO:10), ST6GALNAC3 mRNA (SEQ ID NO:11) and/or ZNF660 mRNA (SEQ ID NO:12) and/or an mRNA sequence having at least 90% sequence identity with a nucleotide sequence selected from the group consisting of SEQ ID NO:7, SEQ ID NO:8, SEQ ID NO:9, SEQ ID NO:10, SEQ ID NO:11 and SEQ ID NO:12. Transcriptional expression products, such as mRNA may be detected by any suitable technique known to the person skilled in the art.

Determining the Translational Expression Level

The methods of the present invention comprises a step of determining the translational expression level of at least one
iii) gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
iv) nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample.

Thus "the translational expression level" as referred to herein is the translational level of at least one
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6.

When the translational expression level in the sample being tested is below the translational expression level of the corresponding gene in a control sample or a standard value, the translational level of the sample being tested is decreased. Thus, a decrease in the translational expression level is measured relative to the translational expression level of a control sample or a standard value. When for example the translational expression level of the AOX1 gene in a control sample has a value of 100, and the translational expression level of the AOX1 gene in a test sample has a value of 50, the translational expression level is said to be decreased by 50%.

The control sample may be an equivalent protein sample from one healthy male without clinically diagnosed prostate cancer or a pool of protein samples from more than one healthy male without clinically diagnosed prostate cancer. The control sample may also be a protein sample from the same person being tested, wherein said control sample has been taken at an earlier time point in the course of disease or before diagnosing the disease. The control sample is taken from the same source, such as for example urine, tissue or blood, as the sample to be tested and the control sample is analysed along with the test sample.

In a particular preferred embodiment a decreased translational expression level of at least one:
gene selected from the group consisting of AOX1, C1orf114, GAS6, HAPLN3, ST6GALNAC3 and ZNF660, and/or
nucleotide sequence having at least 90% sequence identity with at least one nucleotide sequence selected from the group consisting of SEQ ID NO:7, SEQ ID NO:8, SEQ ID NO:9, SEQ ID NO:10, SEQ ID NO:11 and SEQ ID NO:12 or part thereof in a sample is indicative of the presence of prostate cancer.

In one embodiment of the present invention a translational expression level being decreased by at least 10%, or for example at least 15%, 20%, 25%, 30%, 35%, 40%, 41%, 42%, 43%, 44%, 45%, 46%, 47%, 48%, 49%, or at least 50% or even more relative to previous measurements on the same individual, or to measurements on non-diseased tissue from the same individual, or relative to a standard level, is indicative of the presence of prostate cancer.

In another embodiment a translational level decreased by at least 2 fold or more, such as at least 3-fold, at least 4-fold, at least 5-fold or more relative to previous measurements on the same individual, or to measurements on non-diseased tissue from the same individual, or relative to a standard level, is indicative of prostate cancer.

In a more preferred embodiment the translational expression level of at least one:
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
  of a nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
or part thereof in a sample is indicative of the presence of prostate cancer when said transcriptional expression level is decreased by at least 50%.

In a particular embodiment the translational expression level of at least one:
  gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
  nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
or part thereof in a sample is decreased 50% in comparison with the transcriptional level of a control sample.

Methods for Determining Translational Expression Levels

The translational expression products such as peptides and proteins may be detected by any suitable technique or method known to the person skilled in the art.

The translational expression levels may preferably be detected by means of specific antibodies directed to the protein, such as immunofluorescent and/or immunohistochemical staining of the tissue.

Thus, in a preferred embodiment the translational expression level is determined by immunohistochemical analysis.

Immunohistochemical localization of expressed protein may be carried out by immunostaining of tissue sections from for example tissue samples such as a biopsy.

In yet another embodiment the translational expression level is determined by means of conventional enzyme assays, such as ELISA methods.

Furthermore, the translational expression level may be determined by means of peptide/protein chips capable of specifically binding the peptides and/or proteins assessed. Thereby an expression pattern may be obtained.

Translational expression levels of genes may in general be determined by detecting protein from the cells or sample of interest. Thus, in the present invention the transcriptional expression levels of the AOX1, C1orf114, GAS6, HAPLN3, ST6GALNAC3 and/or ZNF660 genes may be determined by detecting AOX1 protein (SEQ ID NO:13), C1orf114 protein (SEQ ID NO:14), GAS6 protein (SEQ ID NO:15), HAPLN3 protein (SEQ ID NO:16), ST6GALNAC3 protein (SEQ ID NO:17) and/or ZNF660 protein (SEQ ID NO:18) and/or an amino acid sequence having at least 90% sequence identity with an amino acid sequence selected from the group consisting of SEQ ID NO:13, SEQ ID NO:14, SEQ ID NO:15, SEQ ID NO:16, SEQ ID NO:17 and SEQ ID NO:18 or part thereof.

The translational expression products as described herein may be detected as indications of prostate cancer of the sample tested, such as diagnosing, predicting, prognosing, monitoring prostate cancer in an individual. The translational expression products of the genes may be detected in either a tissue sample as such, or in a body fluid sample, such as blood, serum, plasma, semen and/or urine of the individual. Preferably, the translational level is measured in a tissue sample, for example a biopsy, prostate tumour tissue, or a tissue of a resected prostate.

When in a tissue section following prostatectomy, if staining for the presence of protein is observed this is considered as an indication that the prediction of disease progression is favourable, for example that the recurrence risk is less severe. In contrast, if no staining can be identified in such a tissue section the prediction of disease progression is unfavourable.

Methods
Method for Assisting in Diagnosing and/or for Diagnosing Prostate Cancer in an Individual One aspect of the present invention relates to a method for assisting in diagnosing and/or for diagnosing prostate cancer in an individual said method comprising
  determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample from said individual, and/or
  determining the transcriptional expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, and/or
  determining the translational expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, wherein the methylation degree and/or the methylation incidence of i) and/or the transcriptional level of ii) and/or the translational expression level of iii) is indicative of presence or absence of prostate cancer.

In another aspect the invention concerns a method of determining if an individual has, or is at risk of developing prostate cancer, the method comprising the steps of:
  a) providing a sample obtained from said individual;
  b) determining in the sample of a),
    the methylation level, and/or
    the transcriptional expression level, and/or
    the translational expression level,
    of one or more nucleotide sequences selected from the group consisting of:
      I') the nucleotide sequence of SEQ ID NO:5 (ST6GALNAC3); or
      I") a nucleotide sequence being complementary to SEQ ID NO: 5; or
      I''') a nucleotide sequence having at least 90% sequence identity to any one of I' or I"; or
      I'''') a fragment of any one of I', I" or I''', wherein the fragment comprises at least 15 consecutive nucleotides of any one of I', I" or I'''; and
      II') the nucleotide sequence of SEQ ID NO:6 (ZNF660); or
      III") a nucleotide sequence being complementary to SEQ ID NO: 6; or
      II''') a nucleotide sequence having at least 90% sequence identity to any one of II' or II"; or
      II'''') a fragment of any one of II', II" or II''', wherein the fragment comprises at least 15 consecutive nucleotides of any one of II', II" or II''';
  c) comparing the methylation level, transcriptional level, and/or translational expression level of the sampled nucleotide sequence of b), with the corresponding methylation level, transcriptional level, and/or translational expression level of a corresponding nucleotide sequence of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

The methylation level, such as the methylation degree and methylation incidence and methods for measuring the methylation degree and methylation incidence are defined in the section "Determining the methylation degree and the methylation incidence".

In one preferred embodiment of the present invention, an increased methylation degree and/or methylation incidence is indicative of the presence of prostate cancer. In another preferred embodiment a decreased methylation degree and/or methylation incidence is indicative of the absence of prostate cancer.

An increased methylation degree and a decreased methylation degree are defined in the section "Determining the methylation degree and the methylation incidence". Similarly, an increased methylation incidence and a decreased methylation incidence are defined in the section "Determining the methylation degree and the methylation incidence".

In one preferred embodiment, a decreased transcriptional expression level and/or translational expression level is indicative of the presence of prostate cancer. In another preferred embodiment an increased transcriptional expression level and/or translational expression level is indicative of the absence of prostate cancer.

The transcriptional/translational expression level and methods for measuring the transcriptional/translational expression level are described in the sections "determining the transcriptional expression level of the AOX1, C1orf114, GAS6, HAPLN3, ST6GALNAC3 and/or ZNF660 genes" and "determining the translational expression level of the AOX1, C1orf114, GAS6, HAPLN3, ST6GALNAC3 and/or ZNF660 genes".

A decreased and increased transcriptional/translational expression level are as defined in the sections "Determining the transcriptional expression level" and "Determining the translational expression level".

In one embodiment, the method for assisting in diagnosing and/or for diagnosing prostate cancer further comprises a step of initiating treatment of prostate cancer if the methylation degree and/or methylation incidence are increased.

Method for Assisting in Prognosing and/or for Prognosing the Disease Progression of Prostate Cancer In another aspect the invention relates to a method for assisting in prognosing and/or for prognosing the disease progression of prostate cancer in an individual having developed prostate cancer comprising the steps of
  i) determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample from said individual, and/or
  ii) determining the transcriptional expression level of at least one gene selected from the group consisting of AOX1, C1orf114, GAS6, HAPLN3, ST6GALNAC3 and/or ZNF660, or nucleotide sequence having at least 90% sequence identity with at least one nucleotide sequence selected from the group consisting of SEQ ID NO:7, SEQ ID NO:8, SEQ ID NO:9, SEQ ID NO:10, SEQ ID NO:11 and SEQ ID NO:12 or part thereof in said sample and/or
  iii) determining the translational expression level of at least one gene selected from the group consisting of AOX1, C1orf114, GAS6, HAPLN3, ST6GALNAC3 and/or ZNF660, or amino acid sequence having at least 90% sequence identity with at least one nucleotide sequence selected from the group consisting of SEQ ID NO:13, SEQ ID NO:14, SEQ ID NO:15, SEQ ID NO:16, SEQ ID NO:17 and SEQ ID NO:18 or part thereof in said sample
  wherein the methylation degree and/or methylation incidence of i) and/or the transcriptional level of ii) and/or the translational expression level of iii) is indicative of the outcome of prostate cancer In yet another aspect the invention concerns a method for prognosing disease progression of prostate cancer in a patient, said method comprising the steps of:
  a) providing a sample obtained from cancerous tissue of an individual;
  b) determining in the sample of a),
    the methylation level, and/or
    the transcriptional expression level, and/or
    the translational expression level,
    of one or more biomarkers, wherein the biomarkers are nucleotide sequences selected from the group consisting of:

I') the nucleotide sequence of SEQ ID NO:2 (C1orf114); or

I") a nucleotide sequence being complementary to SEQ ID NO: 2; or

I''') a nucleotide sequence having at least 90% sequence identity to any one of I' or I"; or I'''') a fragment of any one of I', I" or I''', wherein the fragment comprises at least 15 consecutive nucleotides of any one of I', I" or I'''; and II') the nucleotide sequence of SEQ ID NO:4 (HAPLN3); or II") a nucleotide sequence being complementary to SEQ ID NO: 4; or II''') a nucleotide sequence having at least 90% sequence identity to any one of II' or II"; or II'''') a fragment of any one of II', II" or II''', wherein the fragment comprises at least 15 consecutive nucleotides of any one of I', I" or I'''; and III') the nucleotide sequence of SEQ ID NO:1 (AOX1); or III") a nucleotide sequence being complementary to SEQ ID NO: 1; or III''') a nucleotide sequence having at least 90% sequence identity to any one of III' or III'''; or III'''') a fragment of any one of II', III" or III''', wherein the fragment comprises at least 15 consecutive nucleotides of any one of III', III" or II'''; and IV') the nucleotide sequence of SEQ ID NO:3 (GAS6); or IV") a nucleotide sequence being complementary to SEQ ID NO: 4; or IV''') a nucleotide sequence having at least 90% sequence identity to any one of IV' or IV"; or IV'''') a fragment of any one of IV', IV" or IV''', wherein the fragment comprises at least 15 consecutive nucleotides of any one of IV', IV" or IV'''; and V') the nucleotide sequence of SEQ ID NO:5 (ST6GALNAC3); or V") a nucleotide sequence being complementary to SEQ ID NO: 5; or V''') a nucleotide sequence having at least 90% sequence identity to any one of V' or V"; or V'''') a fragment of any one of V', V" or V''', wherein the fragment comprises at least 15 consecutive nucleotides of any one of V', V" or V'''; and VI') the nucleotide sequence of SEQ ID NO:6 (ZNF660); or VI") a nucleotide sequence being complementary to SEQ ID NO: 6; or VI''') a nucleotide sequence having at least 90% sequence identity to any one of VI' or VI"; or VI'''') a fragment of any one of VI', VI" or VI''', wherein the fragment comprises at least 15 consecutive nucleotides of any one of VI', VI" or VI''';

c) obtaining a biomarker score based on the methylation level, transcriptional level, and/or translational expression level of the sampled nucleotide sequence of b), wherein the biomarker score is indicative of the prognosis of the prostate cancer patient.

The sensitivity of the method of the present invention may in certain embodiments be enhanced by using a panel of biomarkers. Thus in one aspect the invention concerns a method for prognosing disease progression of prostate cancer in a patient, said method comprising the steps of:

a) providing a sample obtained from cancerous tissue of an individual;

b) determining in the sample of a),
the methylation level, and/or
the transcriptional expression level, and/or
the translational expression level,
of a panel comprising one or more nucleotide sequences, wherein the panel is selected from the group consisting of:

i) C1orf114 (SEQ ID NO:2) and HAPLN3 (SEQ ID NO:4);

ii) AOX (SEQ ID NO:1) and C1orf114 (SEQ ID NO:2);

iii) AOX (SEQ ID NO:1), C1orf114 (SEQ ID NO:2) and GAS6 (SEQ ID NO:3);

iv) C1orf114 (SEQ ID NO:2), GAS6 (SEQ ID NO:3) and HAPLN3 (SEQ ID NO:4);

v) C1orf114 (SEQ ID NO:2);

vi) AOX (SEQ ID NO:1), C1orf114 (SEQ ID NO:2) and HAPLN3 (SEQ ID NO:4);

vii) AOX (SEQ ID NO:1), C1orf114 (SEQ ID NO:2), GAS6 (SEQ ID NO:3) and HAPLN3 (SEQ ID NO:4);

viii) C1orf114 (SEQ ID NO:2) and GAS6 (SEQ ID NO:3);

ix) AOX (SEQ ID NO:1) and GAS6 (SEQ ID NO:3);

x) AOX (SEQ ID NO:1);

xi) HAPLN3 (SEQ ID NO:4);

xii) AOX (SEQ ID NO:1) and HAPLN3 (SEQ ID NO:4);

xiii) AOX (SEQ ID NO:1), GAS6 (SEQ ID NO:3) and HAPLN3 (SEQ ID NO:4);

xiv) GAS6 (SEQ ID NO:3) and HAPLN3 (SEQ ID NO:4);

xv) GAS6 (SEQ ID NO:3);

xvi) ST6GALNAC3 (SEQ ID NO:5);

xvii) ZNF660 (SEQ ID NO:6);

xviii) AOX (SEQ ID NO:1) and ST6GALNAC3 (SEQ ID NO:5);

xix) AOX (SEQ ID NO:1) and ZNF660 (SEQ ID NO:6);

xx) C1orf114 (SEQ ID NO:2) and ST6GALNAC3 (SEQ ID NO:5);

xxi) C1orf114 (SEQ ID NO:2) and ZNF660 (SEQ ID NO:6);

xxii) GAS6 (SEQ ID NO:3) and ST6GALNAC3 (SEQ ID NO:5);

xxiii) GAS6 (SEQ ID NO:3) and ZNF660 (SEQ ID NO:6);

xxiv) HAPLN3 (SEQ ID NO:4) and ST6GALNAC3 (SEQ ID NO:5);

xxv) HAPLN3 (SEQ ID NO:4) and ZNF660 (SEQ ID NO:6);

xxvi) ST6GALNAC3 (SEQ ID NO:5) and ZNF660 (SEQ ID NO:6);

xxvii) AOX (SEQ ID NO:1), C1orf114 (SEQ ID NO:2) and ST6GALNAC3 (SEQ ID NO:5);

xxviii) AOX (SEQ ID NO:1), C1orf114 (SEQ ID NO:2) and ZNF660 (SEQ ID NO:6);

xxix) AOX (SEQ ID NO:1), GAS6 (SEQ ID NO:3) and ST6GALNAC3 (SEQ ID NO:5);

xxx) AOX (SEQ ID NO:1), GAS6 (SEQ ID NO:3) and ZNF660 (SEQ ID NO:6);

xxxi) AOX (SEQ ID NO:1), HAPLN3 (SEQ ID NO:4) and ST6GALNAC3 (SEQ ID NO:5);

xxxii) AOX (SEQ ID NO:1), HAPLN3 (SEQ ID NO:4) and ZNF660 (SEQ ID NO:6);

xxxiii) AOX (SEQ ID NO:1), ST6GALNAC3 (SEQ ID NO:5) and ZNF660 (SEQ ID NO:6);

xxxiv) C1orf114 (SEQ ID NO:2), GAS6 (SEQ ID NO:3) and ST6GALNAC3 (SEQ ID NO:5);

xxxv) C1orf114 (SEQ ID NO:2), GAS6 (SEQ ID NO:3) and ZNF660 (SEQ ID NO:6);
xxxvi) C1orf114 (SEQ ID NO:2), HAPLN3 (SEQ ID NO:4) and ST6GALNAC3 (SEQ ID NO:5);
xxxvii) C1orf114 (SEQ ID NO:2), HAPLN3 (SEQ ID NO:4) and ZNF660 (SEQ ID NO:6);
xxxviii) C1orf114 (SEQ ID NO:2), ST6GALNAC3 (SEQ ID NO:5) and ZNF660 (SEQ ID NO:6);
xxxix) GAS6 (SEQ ID NO:3), HAPLN3 (SEQ ID NO:4) and ST6GALNAC3 (SEQ ID NO:5);
xl) GAS6 (SEQ ID NO:3), HAPLN3 (SEQ ID NO:4) and ZNF660 (SEQ ID NO:6);
xli) GAS6 (SEQ ID NO:3), ST6GALNAC3 (SEQ ID NO:5) and ZNF660 (SEQ ID NO:6);
xlii) HAPLN3 (SEQ ID NO:4), ST6GALNAC3 (SEQ ID NO:5) and ZNF660 (SEQ ID NO:6);
xliii) AOX (SEQ ID NO:1), C1orf114 (SEQ ID NO:2), GAS6 (SEQ ID NO:3) and ST6GALNAC3 (SEQ ID NO:5);
xliv) AOX (SEQ ID NO:1), C1orf114 (SEQ ID NO:2), GAS6 (SEQ ID NO:3) and ZNF660 (SEQ ID NO:6);
xlv) AOX (SEQ ID NO:1), C1orf114 (SEQ ID NO:2), HAPLN3 (SEQ ID NO:4) and ST6GALNAC3 (SEQ ID NO:5);
xlvi) AOX (SEQ ID NO:1), C1orf114 (SEQ ID NO:2), HAPLN3 (SEQ ID NO:4) and ZNF660 (SEQ ID NO:6);
xlvii) AOX (SEQ ID NO:1), C1orf114 (SEQ ID NO:2), ST6GALNAC3 (SEQ ID NO:5) and ZNF660 (SEQ ID NO:6);
xlviii) AOX (SEQ ID NO:1), GAS6 (SEQ ID NO:3), HAPLN3 (SEQ ID NO:4) and ST6GALNAC3 (SEQ ID NO:5);
xlix) AOX (SEQ ID NO:1), GAS6 (SEQ ID NO:3), HAPLN3 (SEQ ID NO:4) and ZNF660 (SEQ ID NO:6);
l) AOX (SEQ ID NO:1), GAS6 (SEQ ID NO:3), ST6GALNAC3 (SEQ ID NO:5) and ZNF660 (SEQ ID NO:6);
li) AOX (SEQ ID NO:1), HAPLN3 (SEQ ID NO:4), ST6GALNAC3 (SEQ ID NO:5) and ZNF660 (SEQ ID NO:6);
lii) C1orf114 (SEQ ID NO:2), GAS6 (SEQ ID NO:3), HAPLN3 (SEQ ID NO:4) and ST6GALNAC3 (SEQ ID NO:5);
liii) C1orf114 (SEQ ID NO:2), GAS6 (SEQ ID NO:3), HAPLN3 (SEQ ID NO:4) and ZNF660 (SEQ ID NO:6);
liv) C1orf114 (SEQ ID NO:2), GAS6 (SEQ ID NO:3), ST6GALNAC3 (SEQ ID NO:5) and ZNF660 (SEQ ID NO:6);
lv) C1orf114 (SEQ ID NO:2), HAPLN3 (SEQ ID NO:4), ST6GALNAC3 (SEQ ID NO:5) and ZNF660 (SEQ ID NO:6);
lvi) GAS6 (SEQ ID NO:3), HAPLN3 (SEQ ID NO:4), ST6GALNAC3 (SEQ ID NO:5) and ZNF660 (SEQ ID NO:6);
lvii) AOX (SEQ ID NO:1), C1orf114 (SEQ ID NO:2), GAS6 (SEQ ID NO:3), HAPLN3 (SEQ ID NO:4) and ST6GALNAC3 (SEQ ID NO:5);
lviii) AOX (SEQ ID NO:1), C1orf114 (SEQ ID NO:2), GAS6 (SEQ ID NO:3), HAPLN3 (SEQ ID NO:4) and ZNF660 (SEQ ID NO:6);
lix) AOX (SEQ ID NO:1), C1orf114 (SEQ ID NO:2), GAS6 (SEQ ID NO:3), ST6GALNAC3 (SEQ ID NO:5) and ZNF660 (SEQ ID NO:6);
lx) AOX (SEQ ID NO:1), C1orf114 (SEQ ID NO:2), HAPLN3 (SEQ ID NO:4), ST6GALNAC3 (SEQ ID NO:5) and ZNF660 (SEQ ID NO:6);
lxi) AOX (SEQ ID NO:1), GAS6 (SEQ ID NO:3), HAPLN3 (SEQ ID NO:4), ST6GALNAC3 (SEQ ID NO:5) and ZNF660 (SEQ ID NO:6);
lxii) C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);
lxiii) AOX (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);

wherein any one of said SEQ ID NO: 1, 2, 3, 4, 5 or 6 of said panels i) through lxiii) optionally is individually replaced by:

b') a nucleotide sequence being complementary to any one of said SEQ ID NOs: 1, 2, 3, 4, 5 or 6 of said panels i) through lvii); or b") a nucleotide sequence having at least 90% sequence identity to any one of said SEQ ID NOs: 1, 2, 3, 4, 5 or 6 of said panels i) through lvii), or the complementary nucleotide sequences of b'); or b'") a fragment comprising at least 15 consecutive nucleotides of any one of said SEQ ID NOs: 1, 2, 3, 4, 5 or 6 of said panels i) through lvii), or the nucleotide sequences of b'), or the nucleotide sequences of b"); and c) obtaining a biomarker score based on the methylation level, transcriptional level, and/or translational expression level of the sampled nucleotide sequence of b), wherein the biomarker score is indicative of the prognosis of the prostate cancer patient.

The biomarker score may be any suitable biomarker score known by those of skill in the art. The biomarker score may e.g. be based on the Gleason sum, prostate specific antigen (PSA) amount, MIC-I stromal staining and/or tumour-node-metastasis (TNM) stage.

The present invention provides methods suitable for use during different stages of disease progression of prostate cancer, from testing a non-diseased individual to determining life expectancy of a severely diseased individual afflicted with prostate cancer.

In one such aspect, the invention concerns a method of determining the risk of progression of a prostate cancer patient after therapy, comprising:

a) providing a sample obtained from said patient;
b) determining in the sample of a),
the methylation level, and/or
the transcriptional expression level, and/or
the translational expression level,
of one or more biomarkers, wherein the biomarkers are nucleotide sequences selected from the group consisting of:

I') the nucleotide sequence of SEQ ID NO:2 (C1orf114); or

I") a nucleotide sequence being complementary to SEQ ID NO: 2; or

I'") a nucleotide sequence having at least 90% sequence identity to any one of I' or I"; or I"") a fragment of any one of I', I" or I'", wherein the fragment comprises at least 15 consecutive nucleotides of any one of I', I" or I'"; and II') the nucleotide sequence of SEQ ID NO:4 (HAPLN3); or II") a nucleotide sequence being complementary to SEQ ID NO: 4; or II''') a nucleotide sequence having at least 90% sequence identity to any one of II' or II''; or II'''') a fragment of any one of II', II'' or II''', wherein the fragment comprises at least 15 consecutive nucleotides of any one of I', I'' or I'''; and III') the nucleotide sequence of SEQ ID NO:1 (AOX1); or III'') a nucleotide sequence being complementary to SEQ ID NO: 1; or II''') a nucleotide sequence having at least 90% sequence identity to any one of III' or III''; or II'''') a fragment of any one of III', III'' or III''', wherein the fragment comprises at least 15 consecutive nucleotides of any one of III', III'' or III'''; and IV') the nucleotide sequence of SEQ ID NO:3 (GAS6); or IV'') a nucleotide sequence being complementary to SEQ ID NO: 4; or IV''') a nucleotide sequence having at least 90% sequence identity to any one of IV' or IV''; or IV'''') a fragment of any one of IV', IV'' or IV''', wherein the fragment comprises at least 15 consecutive nucleotides of any one of IV', IV'' or IV'''; and V') the nucleotide sequence of SEQ ID NO:5 (ST6GALNAC3); or V'') a nucleotide sequence being complementary to SEQ ID NO: 5; or V''') a nucleotide sequence having at least 90% sequence identity to any one of V' or V''; or V'''') a fragment of any one of V', V'' or V''', wherein the fragment comprises at least 15 consecutive nucleotides of any one of V', V'' or V'''; and VI') the nucleotide sequence of SEQ ID NO:6 (ZNF660); or VI'') a nucleotide sequence being complementary to SEQ ID NO: 6; or VI''') a nucleotide sequence having at least 90% sequence identity to any one of VI' or VI''; or VI'''') a fragment of any one of VI', VI'' or VI''', wherein the fragment comprises at least 15 consecutive nucleotides of any one of VI', VI'' or VI''';

c) obtaining a biomarker score based on the methylation level, transcriptional level, and/or translational expression level of the sampled nucleotide sequence of b);

d) correlating the methylation level, transcriptional level, and/or translational expression level with the risk of progression.

In another aspect the invention concerns a method for assisting prognosis of disease progression of prostate cancer in an individual having developed prostate cancer, the method comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of i) and/or the transcriptional level of ii) and/or the translational expression level of iii) is indicative of the outcome of prostate cancer In yet another aspect the invention concerns a method for assisting in predicting and/or for predicting the outcome of prostate cancer in an individual having developed prostate cancer comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of a) and/or the transcriptional level of b) and/or the translational expression level of c) is indicative of the outcome of prostate cancer.

It is important to monitor the effect of treatment of prostate cancer in order to apply the correct treatment regime to the individual suffering from prostate cancer. The monitoring may be a combination of methods wherein the method of the present invention is one. Thus in one aspect the invention concerns a method for assisting in monitoring and/or for monitoring the effect of treatment on prostate cancer progression in an individual having developed prostate cancer and being treated for said prostate cancer, comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample wherein the methylation level of i) and/or the transcriptional level of ii) and/or the translational expression level of iii) is indicative of prostate cancer progression.

An increased methylation level is typically indicative of poor outcome, while a decreased transcriptional and/or translational expression level in the sample is indicative of poor outcome of the disease, e.g. decreased life expectancy.

An increased methylation level is typically indicative of high recurrence risk of prostate cancer, and a decreased transcriptional and/or translational expression level is also typically indicative of high recurrence risk of prostate cancer.

The recurrence risk may be determined at any suitable time as determined by the person of skill in the art. In one embodiment the recurrence risk is determined following radical prostatectomy.

An increased methylation level in a sample from an individual is indicative of a progression of prostate cancer, when compared to the methylation level in a sample taken from the same individual before treatment onset and/or at an earlier time point during treatment Similarly, a decreased transcriptional and/or translational expression level in a sample from an individual is also indicative of a progression of prostate cancer when compared to the transcriptional and/or translational expression level in a sample taken from the same individual before treatment onset and/or at an earlier time point during treatment.

In a further aspect the present invention concerns a method for assisting in monitoring and/or for monitoring the progression of prostate cancer from a silent/indolent to an aggressive prostate cancer in an individual having developed prostate cancer comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO: 1, SEQ ID NO:3, SEQ ID NO:5, and SEQ ID NO:6 or part thereof in said sample wherein increased methylation level of a) and/or decreased transcriptional level of b) and/or decreased translational expression level of c) is indicative of the progression of prostate cancer from a silent/indolent to an aggressive prostate cancer.

In one embodiment the silent/indolent prostate cancer is a slow-growing and slow-progressing organ-confined prostate cancer with no or only minor clinical symptoms. An aggressive prostate cancer is one which has progressed or will progress relatively fast (i.e. within the remaining life expectancy of a given patient) to non-organ-confined prostate cancer: Such an aggressive cancer is considered to be a treatment-requiring prostate cancer.

An increased methylation level is indicative of a progression of prostate cancer when compared to the methylation level measured at an earlier time point of the course of disease of said prostate cancer. Analogously, decreased transcriptional and/or translational expression levels are indicative of progression of the prostate cancer, when compared to transcriptional and/or translational expression level measured at an earlier time point of the course of disease of said prostate cancer.

The methods of the present invention may be used by the clinician or other person of skill in the art to assist in determining and/or determining the treatment regime of an individual having developed prostate cancer. In one such aspect the invention concerns a method comprising the steps of:

a) determining the methylation level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6) or determining the methylation level of at least one nucleotide sequence having at least 90% sequence identity with a nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in a sample from said individual, and/or b) determining the transcriptional expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample and/or
c) determining the translational expression level of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:2, SEQ ID NO:4, SEQ ID NO:1, SEQ ID NO:3, SEQ ID NO:5, and SEQ ID NO:6 or part thereof in said sample
wherein the methylation level of a) and/or the transcriptional level of b) and/or the translational expression level of c) is indicative of the treatment regime to be offered to the individual having developed prostate cancer.

In one embodiment the method comprises the steps of:
a) determining the methylation level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or nucleotide sequence having at least 90% sequence identity with a nucleotide sequence selected from the group consisting of SEQ ID NO:7, SEQ ID NO:8, SEQ ID NO:9, SEQ ID NO:10, SEQ ID NO:11 and SEQ ID NO:12, or part thereof in a control sample;
b) determining the methylation level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) as identified in a) in a sample from said individual;
c) comparing the methylation level determined in a) and b), wherein if the methylation level determined in b) is higher than the methylation level determined in a) then the methylation level is increased and wherein if the methylation level determined in b) is lower than the methylation level determined in a) then the methylation level is decreased.

In one embodiment the individual from which the sample originates has a normal prostate specific antigen (PSA) level. In another embodiment the individual has a PSA level higher than a normal PSA level. A normal PSA level is a PSA level of at the most 3 ng per mL serum.

The term prognosing as used herein refers to predicting the probable outcome or course of disease independent of possible intervention or treatment for example in the form of surgery, medication etc. Prognosing may refer to the likelihood of recovery from disease after intervention or treatment. Prognosing may also refer to predicting the time to recurrence and/or predicting the time to cancer specific death. The time to cancer specific death may for example be predicted after conservative treatment or watchful waiting.

In conservative treatment or watchful waiting, treatment is delayed in favour of careful monitoring for the progression of prostate cancer. Watchful waiting may also be referred to as expectant management, conservative management, observation, or surveillance. The theory behind watchful waiting is that most prostate cancers, specifically prostate adenocarcinomas, usually grow very slowly. Patients who have low Gleason score, other medical complications, or low grade tumours may wish to postpone treatment due to the side effects.

However, it is very difficult to make a precise prediction of pathological stage based on microscopic examination of prostate needle biopsies as used for determination of the clinical T-stage. Therefore, the methylation level and/or the transcriptional expression level and/or the translational expression level of the genes may be used as a surrogate marker for prognosing disease progression of prostate cancer.

According to the method for assisting in prognosing and/or prognosing the disease progression, an increased methylation degree and/or methylation incidence is indicative of a poor outcome. Similarly, a decreased transcriptional and/or translational expression level in the sample is indicative of a poor outcome. A poor outcome may represent a decrease in the time to recurrence and/or a decrease in the time to cancer specific death for example after conservative treatment. A poor outcome may also represent an increased risk of death after conservative treatment or watchful waiting. Thus, a poor outcome can indicate that a specific treatment should be initialized.

In one embodiment a poor outcome may also represent an increased risk of PSA recurrence after radical prostatectomy. In one particular embodiment an increased methylation degree and/or incidence of C1orf114 (SEQ ID NO:2) indicates an increased risk of PSA recurrence after radical prostatectomy. This is exemplified in Table 7, right column, where multivariate analysis indicates that the methylation level of C1orf114 is a strong independent prognostic marker for prostate cancer. In another particular embodiment an increased methylation degree and/or incidence of AOX1 (SEQ ID NO:1), C1orf114 (SEQ ID NO:2) and HAPLN3 (SEQ ID NO:4) indicates an increased risk of PSA recurrence after radical prostatectomy. This is exemplified in Table 9.

Methylation degree, methods for determining the methylation degree and an increased methylation degree is defined in the section "Determining the methylation degree and the methylation incidence". Methylation incidence, methods for determining the methylation incidence and an increased methylation incidence is defined in the section "Determining the methylation degree and the methylation incidence".

In one preferred embodiment of the present invention the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6
in a urine sample is considered to be increased and indicative of a poor outcome when said methylation degree is determined to be above 0.1%.

In another preferred embodiment of the present invention the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is considered to be increased and indicative of a poor outcome when said methylation degree is determined to be above 0.1%.

In a more preferred embodiment of the present invention the methylation incidence of a gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6 in a sample is considered to be increased and indicative of a poor outcome when said methylation degree is determined to be above 0.01%.

In a particular preferred embodiment the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is considered to be increased and indicative of a poor outcome when said methylation degree is determined to be above 0.001%.

The transcriptional/translational expression level and methods for measuring the transcriptional/translational expression level and a decreased transcriptional/translational expression level are described and defined in the sections "Determining the transcriptional expression level" and "Determining the translational expression level".

In one embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
being decreased by at least 10%, or for example at least 15%, 20%, 25%, 30%, 35%, 40%, 41%, 42%, 43%, 44%, 45%, 46%, 47%, 48%, 49%, or at least 50% and even more relative to previous measurements on the same individual, or to measurements on non-diseased tissue from the same individual, or relative to a standard level, is indicative of a poor outcome.

In another embodiment a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
being decreased by at least 2 fold or more, such as at least 3-fold, at least 4-fold, at least 5-fold or more relative to previous measurements on the same individual, or to measurements on non-diseased tissue from the same individual, or relative to a standard level, is indicative of a poor outcome.

In a preferred embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6
being decreased by at least 45%, or for example at least 46%, 47%, 48%, 49%, 50%, 51%, 52%, 53%, 54%, 55%, 56%, 57%, 58%, 59% or at least 60% and even more relative to previous measurements on the same individual, or to measurements on non-diseased tissue from the same individual, or relative to a standard level, is indicative of a poor outcome.

In a more preferred embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
being decreased by at least 50% relative to previous measurements on the same individual, or to measurements on non-diseased tissue from the same individual, or relative to a standard level, is indicative of a poor outcome.

Method for assisting in predicting and/or for predicting the outcome of prostate cancer A method for assisting in predicting and/or for predicting the outcome of prostate cancer in an individual having developed prostate cancer comprising:
i) determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample from said individual, and/or
ii) determining the transcriptional expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, and/or
iii) determining the translational expression level of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, wherein the methylation degree and/or methylation incidence of i) and/or the transcriptional level of ii) and/or the translational expression level of iii) is indicative of the outcome of prostate cancer.

The term predicting as used herein refers to predicting the outcome or course of disease following intervention for example in the form of surgery, medication etc. For example such an intervention may be radical prostatectomy.

According to this method for assisting in predicting and/or predicting the outcome of prostate cancer an increased methylation degree and/or methylation incidence is indicative of a poor outcome. Similarly, a decreased transcriptional and/or translational expression level in the sample is indicative of a poor outcome. A poor outcome may represent a decrease in the time to recurrence and/or a decrease in the time to cancer specific death for example after conservative treatment. A poor outcome may also represent an increased risk of death after conservative treatment or watchful waiting.

Methylation degree, methods for determining the methylation degree and an increased methylation degree is defined in the section "Determining the methylation degree and the methylation incidence". Methylation incidence, methods for determining the methylation incidence and an increased methylation incidence is defined in the section "Determining the methylation degree and the methylation incidence".

In one preferred embodiment of the present invention the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is determined to be above 20%, when said sample is a tissue sample.

In one preferred embodiment of the present invention the methylation degree of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a urine sample is considered to be increased and indicative of a poor outcome being when said methylation degree is determined to be above 0.1%.

In another preferred embodiment of the present invention the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is considered to be increased and indicative of a poor outcome being when said methylation degree is determined to be above 0.1%.

In a more preferred embodiment of the present invention the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is considered to be increased and indicative of a poor outcome being when said methylation degree is determined to be above 0.01%.

In a particular preferred embodiment the methylation incidence of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
in a sample is considered to be increased and indicative of a poor outcome being when said methylation degree is determined to be above 0.001%.

The transcriptional/translational expression level and methods for measuring the transcriptional/translational expression level and a decreased transcriptional/translational expression level are described and defined in the sections "Determining the transcriptional expression level" and "Determining the translational expression level".

In one embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
being decreased by at least 10%, or for example at least 15%, 20%, 25%, 30%, 35%, 40%, 41%, 42%, 43%, 44%, 45%, 46%, 47%, 48%, 49%, or at least 50% and even more relative to previous measurements on the same individual, or to measurements on non-diseased tissue from the same individual, or relative to a standard level, is indicative of a poor outcome.

In another embodiment a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or
nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6
being decreased by at least 2 fold or more, such as at least 3-fold, at least 4-fold, at least 5-fold or more relative to previous measurements on the same individual, or to measurements on non-diseased tissue from the same individual, or relative to a standard level, is indicative of a poor outcome.

In a preferred embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 being decreased by at least 45%, or for example at least 46%, 47%, 48%, 49%, 50%, 51%, 52%, 53%, 54%, 55%, 56%, 57%, 58%, 59% or at least 60% and even more relative to previous measurements on the same individual, or to measurements on non-diseased tissue from the same individual, or relative to a standard level, is indicative of a poor outcome.

In a more preferred embodiment of the present invention a transcriptional and/or translational level of a
gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), and/or nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 being decreased by at least 50% relative to previous measurements on the same individual, or to measurements on non-diseased tissue from the same individual, or relative to a standard level, is indicative of a poor outcome.

It is appreciated that the recurrence risk is the risk of cancer recurring after intervention, for example following surgery, radical prostatectomy, radiation therapy, cryotherapy or brachytherapy. Recurrence can occur over a wide span in time, for example 2 months after intervention, such as 3 months, 4, months, 5 months, 6 months, 1 year, two years, three years, 4 years, 5, years, after intervention or even longer. Thus, the methods of the present invention can be used over a wide span of time to determine whether recurrence has occurred.

In a preferred embodiment an increased methylation degree and/or methylation incidence is indicative of high recurrence risk of prostate cancer. It is also preferred that a decreased transcriptional and/or translational expression level is indicative of high recurrence risk of prostate cancer.

In a preferred embodiment the recurrence risk is determined following radical prostatectomy.

Method for Assisting in Monitoring and/or for Monitoring the Effect of Treatment on Prostate Cancer Progression Another aspect of the present invention relates to a method for assisting in monitoring and/or for monitoring the effect of treatment on prostate cancer progression in an individual having developed prostate cancer and being treated for said prostate cancer, comprising:
i) determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample from said individual, and/or
ii) determining the transcriptional expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, and/or
iii) determining the translational expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample,
wherein the methylation degree and/or methylation incidence of i) and/or the transcriptional level of ii) and/or the translational expression level of iii) is indicative of prostate cancer progression.

The term "monitoring" refers to observing or watching the progression or development of prostate cancer of an individual. The progression of prostate cancer of an individual may be monitored by frequently taking samples from the individual having prostate cancer and determining the methylation degree and/or methylation incidence and/or the transcriptional expression level and/or the translational expression level as described herein. Samples may for example be taken on a weekly or monthly basis. However, sampling frequencies may be regulated depending on the individual and the stage of cancer.

To monitor the effect of treatment, the methylation degree and/or methylation incidence and/or the transcriptional expression level and/or the translational expression level may be determined before and after treatment and compared or at different time point during treatment and compared. The methylation degree and/or methylation incidence and/or the transcriptional expression level and/or the translational expression level may in an embodiment be determined at different time points after treatment such as for example 1 week after treatment or 1 month after treatment, such as 2 months, 3 months, 4, months, 5 months, 6 months, 1 year, two years, three years, 4 years, 5, years or even more years after treatment.

According to this method for assisting in monitoring and/or for monitoring the effect of treatment on prostate cancer progression, an increased methylation degree and/or methylation incidence in a sample from an individual, when compared to the methylation degree and/or methylation incidence in a sample taken from the same individual
before treatment onset and/or
at an earlier time point during treatment
is indicative of a progression of said prostate cancer.

Methylation degree, methods for determining the methylation degree and an increased/decreased methylation degree is defined in the section "Determining the methylation degree and the methylation incidence". Methylation incidence, methods for determining the methylation incidence and an increased/decreased methylation incidence is defined in the section "Determining the methylation degree and the methylation incidence".

In one preferred embodiment of the present invention, an increased methylation degree and/or methylation incidence in a sample from an individual, when compared to the methylation degree and/or methylation incidence in a sample taken from the same individual
   before treatment onset and/or
   at an earlier time point during treatment
is indicative of a progression of said prostate cancer.

A methylation degree and/or methylation incidence increased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more in a sample from an individual, when compared to the methylation degree and/or methylation incidence in a sample taken from the same individual
   before treatment onset and/or
   at an earlier time point during treatment
is indicative of a progression of said prostate cancer.

A methylation degree and/or methylation incidence increased by at least 1.5-fold or for example at least 2-fold, 3-fold, 5-fold, 10-fold or even more in a sample from an individual, when compared to the methylation degree and/or methylation incidence in a sample taken from the same individual
   before treatment onset and/or
   at an earlier time point during treatment
is indicative of a progression of said prostate cancer.

Further, a decreased methylation degree when compared to the methylation degree before treatment onset is indicative of a positive effect of the treatment and that the individual is in recovery. Similarly an increased transcriptional and/or translational expression level, when compared to the methylation degree before treatment onset, is indicative of a positive effect of the treatment and that the individual is in recovery.

A methylation degree and/or methylation incidence decreased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more in a sample from an individual, when compared to the methylation degree and/or methylation incidence in a sample taken from the same individual
   before treatment onset and/or
   at an earlier time point during treatment
is indicative of a positive effect of the treatment and that the individual is in recovery.

A methylation degree and/or methylation incidence in a sample decreased by at least 1.5-fold or for example at least 2-fold, 3-fold, 5-fold, 10-fold or even more in a sample from an individual, when compared to the methylation degree and/or methylation incidence in a sample taken from the same individual
   before treatment onset and/or
   at an earlier time point during treatment
is indicative of a positive effect of the treatment and that the individual is in recovery.

It is preferred that a decreased transcriptional and/or translational expression level in a sample from an individual, when compared to the transcriptional and/or translational expression level in a sample taken from the same individual
   before treatment onset and/or
   at an earlier time point during treatment
is indicative of a progression of said prostate cancer.

In one embodiment of the present invention a transcriptional and/or translational expression level in a sample from an individual being decreased at least 10%, or for example at least 15%, 20%, 25%, 30%, 35%, 40%, 41%, 42%, 43%, 44%, 45%, 46%, 47%, 48%, 49%, or at least 50% and even more, when compared to the transcriptional and/or translational expression level in a sample taken from the same individual
   before treatment onset and/or
   at an earlier time point during treatment
is indicative of a progression of said prostate cancer.

In another embodiment of the present invention a transcriptional and/or translational level in a sample from an individual being decreased at least 2 fold or more, such as at least 3-fold, at least 4-fold, at least 5-fold or more, when compared to the transcriptional and/or translational expression level in a sample taken from the same individual
   before treatment onset and/or
   at an earlier time point during treatment
is indicative of a progression of said prostate cancer.

In one preferred embodiment of the present invention a transcriptional and/or translational level in a sample from an individual being decreased by at least 45%, or for example at least 46%, 47%, 48%, 49%, 50%, 51%, 52%, 53%, 54%, 55%, 56%, 57%, 58%, 59% or at least 60% and even more, when compared to the transcriptional and/or translational expression level in a sample taken from the same individual
   before treatment onset and/or
   at an earlier time point during treatment
is indicative of a progression of said prostate cancer.

In a more preferred embodiment of the present invention a transcriptional and/or translational in a sample from an individual level being decreased by at least 50%, when compared to the transcriptional and/or translational expression level in a sample taken from the same individual
   before treatment onset and/or
   at an earlier time point during treatment
is indicative of a progression of said prostate cancer.

In another preferred embodiment of the present invention a transcriptional and/or translational in a sample from an individual level being increased by at least 50%, when compared to the transcriptional and/or translational expression level in a sample taken from the same individual
   before treatment onset and/or
   at an earlier time point during treatment
is indicative of a regression of said prostate cancer.

Method for Assisting in Monitoring and/or for Monitoring the Progression of Prostate Cancer from a Silent/Indolent to an Aggressive Prostate Cancer Individuals suspected of having developed prostate cancer, or suspected to be at risk of developing prostate cancer, or having been diagnosed with prostate cancer may be enrolled in an active surveillance programme. Active surveillance refers to observation and regular monitoring of outbreak without invasive treatment. Thus, active surveillance is often used when an early stage, slow-growing prostate cancer is suspected. For younger men (>10 years life expectancy), a programme of active surveillance may not mean avoiding treatment altogether, but may allow a delay of a few years or more, during which time the quality of life impact of active treatment can be avoided. Carefully selected men will not miss a window for cure with this approach. Careful selection of individuals for active surveillance ensures that the selected individuals will not be less prone to cure than other individuals.

Programmes for 'watchful waiting' may also be suggested when the risks of surgery, radiation therapy, or hormonal therapy outweigh the possible benefits. Other treatments can be started if symptoms develop, or if there are signs that the cancer growth is accelerating (e.g., rapidly rising PSA, increase in Gleason score on repeat biopsy, etc.).

The markers of the present invention can be used for monitoring prostate cancer progression, as independent markers, but preferably with one or more markers such as the PSA marker, the SLC18A2 gene, the ZNF132 gene and/or the TFF3 gene, and characterisation of stage and grade of the prostate cancer in said individual.

Thus, in another aspect the present invention relates to a method for assisting in monitoring and/or for monitoring the progression of prostate cancer from a silent/indolent to an aggressive prostate cancer in an individual having developed prostate cancer comprising:
i) determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO: 1, SEQ ID NO:2, SEQ ID NO:3, SEQ ID NO:4, SEQ ID NO:5 and SEQ ID NO:6 or part thereof in a sample from said individual, and/or
ii) determining the transcriptional expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, and/or
iii) determining the translational expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample,
wherein increased methylation degree and/or methylation incidence of i) and/or decreased transcriptional level of ii) and/or decreased translational expression level of iii) is indicative of the progression of prostate cancer from a silent/indolent to an aggressive prostate cancer.

In one embodiment a silent/indolent prostate cancer is a slow-growing and slow-progressing organ-confined prostate cancer with no or only minor clinical symptoms.

In one embodiment an aggressive prostate cancer is one which has progressed or will progress relatively fast (i.e. within the remaining life expectancy of a given patient) to non-organ-confined prostate cancer. In another embodiment an aggressive prostate cancer is a treatment-requiring prostate cancer.

According to this method for assisting in monitoring and/or for monitoring the progression of prostate cancer from a silent/indolent to an aggressive prostate cancer, a methylation degree and/or methylation incidence in a sample from an individual, wherein said methylation degree is increased when compared to methylation degree and/or methylation incidence in a sample taken from the same individual at an earlier time point of the course of disease of said prostate cancer, is indicative a progression of said prostate cancer. Similarly a decreased transcriptional and/or translational expression level in a sample from an individual, when compared to transcriptional and/or translational expression level in a sample taken from the same individual at an earlier time point of the course of disease of said prostate cancer, is indicative a progression of said prostate cancer.

In one embodiment a methylation degree and/or methylation incidence in a sample from an individual, wherein said methylation degree is increased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more, when compared to the methylation degree in a sample taken from the same individual at an earlier time point of the course of disease of said prostate cancer, is indicative a progression of said prostate cancer.

In another embodiment a methylation degree and/or methylation incidence in a sample from an individual, wherein said methylation degree is increased by at least 1.5-fold or for example at least 2-fold, 3-fold, 5-fold, 10-fold or even more, when compared to the methylation degree in a sample taken from the same individual at an earlier time point of the course of disease of said prostate cancer, is indicative a progression of said prostate cancer.

Further, a methylation degree and/or methylation incidence in a sample from an individual, wherein said methylation degree and/or methylation incidence is decreased when compared to the methylation degree in a sample taken from the same individual at an earlier time point of the course of disease of said prostate cancer, indicates that the individual is in recovery.

A methylation degree and/or methylation incidence in a sample from an individual, wherein said methylation degree and/or methylation incidence is decreased by at least 10% or for example at least 15%, 20%, 25%, 30%, 35%, 40%, 41%, 42%, 43%, 44%, 45%, 46%, 47%, 48%, 49%, 50%, 55%, 60%, 65%, 70%, 80%, 90%, 100% or even more, when compared to the methylation degree in a sample taken from the same individual at an earlier time point of the course of disease of said prostate cancer, indicates that the individual is in recovery.

A methylation degree in a sample decreased by at least 1.5-fold or for example at least 2-fold, 3-fold, 5-fold, 10-fold or even more, when compared to the methylation degree before treatment onset is indicative of a positive effect of the treatment and that the individual is in recovery.

A decreased transcriptional and/or translational expression level in a sample from an individual, when compared to transcriptional and/or translational expression level in a sample taken from the same individual at an earlier time point of the course of disease of said prostate cancer, is indicative a progression of said prostate cancer.

In one embodiment of the present invention a transcriptional and/or translational expression level in a sample from an individual, wherein said transcriptional and/or translational expression level is decreased by at least 10%, or for example at least 15%, 20%, 25%, 30%, 35%, 40%, 41%, 42%, 43%, 44%, 45%, 46%, 47%, 48%, 49%, or at least 50% or even more when compared to the transcriptional and/or translational expression level in a sample taken from the same individual at an earlier time point of the course of disease of said prostate cancer, is indicative a progression of said prostate cancer.

In another embodiment a transcriptional and/or translational expression level in a sample from an individual, wherein said transcriptional and/or translational expression level is decreased by at least 2 fold or more, such as at least 3-fold, at least 4-fold, at least 5-fold or even more when compared to the transcriptional and/or translational expression level in a sample taken from the same individual at an earlier time point of the course of disease of said prostate cancer, is indicative a progression of said prostate cancer.

In one preferred embodiment a transcriptional and/or translational expression level in a sample from an individual, wherein said transcriptional and/or translational expression level is decreased by at least 46%, 47%, 48%, 49%, 50%, 51%, 52%, 53%, 54%, 55%, 56%, 57%, 58%, 59% or at least 60% or even more when compared to the transcriptional and/or translational expression level in a sample taken from the same individual at an earlier time point of the course of disease of said prostate cancer, is indicative a progression of said prostate cancer.

In a more preferred embodiment a transcriptional and/or translational expression level in a sample from an individual, wherein said transcriptional and/or translational expression level is decreased by at least 50% when compared to the transcriptional and/or translational expression level in a sample taken from the same individual at an earlier time point of the course of disease of said prostate cancer, is indicative a progression of said prostate cancer.

In one embodiment an increased transcriptional and/or translational expression level in a sample from an individual, wherein said transcriptional and/or translational expression level is increased when compared to the transcriptional and/or translational expression level in a sample taken from the same individual at an earlier time point of the course of disease of said prostate cancer, indicates that the individual is in recovery.

Method for Treating and/or Assisting in Determining and/or Determining the Treatment Regime of an Individual A method for assisting in determining and/or determining the treatment regime of an individual having developed prostate cancer comprising:
  i) determining the methylation degree and/or the methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or determining the methylation degree and/or the methylation incidence of at least one nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in a sample from said individual, and/or
  ii) determining the transcriptional expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, and/or
  iii) determining the translational expression level of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), or nucleotide sequence having at least 90% sequence identity with at least one nucleotide sequence selected from the group consisting of SEQ ID NO:1, SEQ ID NO:2, SEQ ID NO:3, SEQ ID NO:4, SEQ ID NO:5 and SEQ ID NO:6 or part thereof in said sample, wherein the methylation degree and/or methylation incidence of i) and/or the transcriptional level of ii) and/or the translational expression level of iii) is indicative of the treatment regime to be offered to the individual having developed prostate cancer.

In one aspect the invention concerns a method of identifying a prostate cancer patient in need of adjuvant therapy, comprising:
  a) providing a sample obtained from cancerous tissue of an individual;
  b) determining in the sample of a),
    the methylation level, and/or
    the transcriptional expression level, and/or
    the translational expression level,
    of one or more biomarkers, wherein the biomarkers are nucleotide sequences selected from the group consisting of:
    I') the nucleotide sequence of SEQ ID NO:3 (GAS6); or
    I'') a nucleotide sequence being complementary to SEQ ID NO: 3; or
    I''') a nucleotide sequence having at least 90% sequence identity to any one of I' or I''; or
    I'''') a fragment of any one of I', I'' or I''', wherein the fragment comprises at least 15 consecutive nucleotides of any one of I', I'' or I'''; and
    II') the nucleotide sequence of SEQ ID NO:4 (HAPLN3); or
    II'') a nucleotide sequence being complementary to SEQ ID NO: 4; or
    II''') a nucleotide sequence having at least 90% sequence identity to any one of II' or II''; or
    II'''') a fragment of any one of II', II'' or II''', wherein the fragment comprises at least 15 consecutive nucleotides of any one of I', I'' or I'''; and
    III') the nucleotide sequence of SEQ ID NO:1 (AOX1); or
    III'') a nucleotide sequence being complementary to SEQ ID NO: 1; or
    III''') a nucleotide sequence having at least 90% sequence identity to any one of III' or III'''; or
    III'''') a fragment of any one of III', III'' or III''', wherein the fragment comprises at least 15 consecutive nucleotides of any one of III', III'' or III'''; and
    IV') the nucleotide sequence of SEQ ID NO:2 (C1orf114); or
    IV'') a nucleotide sequence being complementary to SEQ ID NO: 2; or
    IV''') a nucleotide sequence having at least 90% sequence identity to any one of IV' or IV''; or
    IV'''') a fragment of any one of IV', IV'' or IV''', wherein the fragment comprises at least 15 consecutive nucleotides of any one of IV', IV'' or IV'''; and
    V') the nucleotide sequence of SEQ ID NO:5 (ST6GALNAC3); or
    V'') a nucleotide sequence being complementary to SEQ ID NO: 5; or
    V''') a nucleotide sequence having at least 90% sequence identity to any one of V' or V''; or
    V'''') a fragment of any one of V', V'' or V''', wherein the fragment comprises at least 15 consecutive nucleotides of any one of V', V'' or V'''; and VI') the nucleotide sequence of SEQ ID NO:6 (ZNF660); or VI") a nucleotide sequence being complementary to SEQ ID NO: 6; or VI''') a nucleotide sequence having at least 90% sequence identity to any one of VI' or VI'''; or VI'''') a fragment of any one of VI', VI" or VI''', wherein the fragment comprises at least 15 consecutive nucleotides of any one of VI', VI" or VI''';

c) obtaining biomarker scores based on the methylation level, transcriptional level, and/or translational expression level of the sampled nucleotide sequence of b), wherein the biomarker scores indicate if the patient is in need of adjuvant therapy.

The adjuvant therapy may be selected from the group consisting of radiation therapy, chemotherapy, immunotherapy, hormone therapy, and targeted therapy.

In one aspect the invention concerns a method of treating a prostate cancer patient comprising determining at least one clinical parameter for said patient, determining the status of at least one gene selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), in a sample obtained from the patient, and (a) recommending, prescribing or initiating active treatment if said patient has at least one risk-associated clinical parameter and an elevated status for said gene, or (b) recommending, prescribing or initiating watchful waiting if said patient has neither a risk-associated clinical parameter nor an elevated status for said gene or genes.

The term "treatment regime" refers to a strategy for treatment of an individual. Determining the treatment regime of an individual means choosing a strategy for treatment of the individual. The treatment regime or the strategy for treatment of an individual having developed prostate cancer is determined based on the method as described above.

For example, in case of T1 and T2 cancers, which are found only in the prostate, the preferred treatment regime will be surgery. In case of T3 and T4 cancers, which have spread elsewhere, the preferred treatment regime will be radiation therapy. However, it is often difficult to determine whether the cancer has developed into a T3 or T4 stage.

Thus, in one embodiment an increased methylation degree and/or methylation incidence will indicate that the treatment regime should be radiation therapy. Similarly, a decreased transcriptional and/or translational expression level will indicate that the treatment regime should be radiation therapy.

In particular an increased methylation degree and an increased methylation incidence may be as described above, and a decreased transcriptional and/or translational expression level may be as described above.

In one embodiment of the present invention a transcriptional and/or translational expression level in a sample from an individual, wherein said transcriptional and/or translational expression level is decreased by at least 10%, or for example at least 15%, 20%, 25%, 30%, 35%, 40%, 41%, 42%, 43%, 44%, 45%, 46%, 47%, 48%, 49%, or at least 50% and even more when compared to previous measurements on the same individual, or to measurements on non-diseased tissue from the same individual, or relative to a standard level, will indicate that the treatment regime should be radiation therapy.

In another embodiment a transcriptional and/or translational level in a sample from an individual, wherein said transcriptional and/or translational expression level is decreased by at least 2 fold or more, such as at least 3-fold, at least 4-fold, at least 5-fold or more relative to previous measurements on the same individual, or to measurements on non-diseased tissue from the same individual, or relative to a standard level, will indicate that the treatment regime should be radiation therapy.

In one preferred embodiment of the present invention a transcriptional and/or translational expression level in a sample from an individual, wherein said transcriptional and/or translational expression level is decreased by at least 45%, or for example at least 46%, 47%, 48%, 49%, 50%, 51%, 52%, 53%, 54%, 55%, 56%, 57%, 58%, 59% or at least 60% and even more relative to previous measurements on the same individual, or to measurements on non-diseased tissue from the same individual, or relative to a standard level, will indicate that the treatment regime should be radiation therapy.

In a more preferred embodiment a transcriptional and/or translational expression level in a sample from an individual, wherein said transcriptional and/or translational expression level is decreased by at least 50% relative to previous measurements on the same individual, or to measurements on non-diseased tissue from the same individual, or relative to a standard level, will indicate that the treatment regime should be radiation therapy.

The methods as described herein may optionally comprise:

i) determining the methylation degree and/or methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6, or part thereof in a control sample ii) determining the methylation degree and/or methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) as identified in i) in a sample from said individual iii) comparing the methylation degree and/or methylation incidence determined in i) and ii)

wherein if the methylation degree and/or methylation incidence determined in ii) is higher than the methylation degree and/or methylation incidence determined in i) then the methylation degree and/or methylation incidence is increased and wherein if the methylation degree and/or methylation incidence determined in ii) is lower than the methylation degree and/or methylation incidence determined in i) then the methylation degree and/or methylation incidence is decreased.

Further, the methods as described herein may optionally comprise a step of comparing the transcriptional and/or translational expression level in the sample to the expression level of a control sample, wherein the expression level in the sample is increased, when it is higher than the expression level in said control sample or decreased when it is lower than the expression level in said control sample. Such a control sample is described in the sections "Determining transcriptional expression level" and "Determining translational expression level". In one embodiment the translational expression level of AOX1, C1orf114, GAS6, HAPLN3, ST6GALNAC3 and/or ZNF660 is determined by immunohistochemical analysis.

In one embodiment, the sample of the methods as described herein is a tissue sample. In a preferred embodiment the tissue sample is a biopsy of the prostate gland or resected prostate tissue. In another embodiment the sample is a body fluid sample such as a blood, serum, semen, plasma or urine sample.

Combination with Other Biomarkers

The present invention provides a marker which can be used independently of other markers or in combination with other markers and techniques. The AOX1, C1orf114, GAS6, HAPLN3, ST6GALNAC3 and/or ZNF660 markers of the present invention may for example be used in combination with a panel of genetic biomarkers as described below. Thus, the methods for assisting in diagnosing and/or for diagnosing prostate cancer in an individual cancer and/or for assisting in prognosing and/or for prognosing the disease progression of prostate cancer in an individual having developed prostate cancer and/or for assisting in predicting and/or for predicting the outcome of prostate cancer in an individual having developed prostate cancer and/or for assisting in monitoring and/or for monitoring the effect of treatment on prostate cancer progression in an individual having developed prostate cancer and being treated for said prostate cancer and/or for assisting in monitoring and/or for monitoring the progression of prostate cancer from a silent/indolent to an aggressive prostate cancer in an individual having developed prostate cancer and/or for assisting in determining and/or determining the treatment regime of an individual having developed prostate cancer may further comprise determining the methylation degree and/or translational level and/or transcriptional level of one or more biomarkers.

In certain embodiments, it may be advantageous to combine different genes in a panel of genes. In one such aspect concerning diagnostic use of all six genes in combination, a method is provided for determining if an individual has, or is at risk of developing prostate cancer, the method comprising the steps of:

a) providing a sample obtained from said individual;
b) determining in the sample of a),
  the methylation level, and/or
  the transcriptional expression level, and/or
  the translational expression level,
  of a panel of nucleotide sequences, wherein the panel comprises:
  I') the nucleotide sequence of SEQ ID NO:3 (GAS6); or
  I") a nucleotide sequence being complementary to SEQ ID NO: 3; or
  I'") a nucleotide sequence having at least 90% sequence identity to any one of I' or I"; or
  I'"") a fragment of any one of I', I" or I'", wherein the fragment comprises at least 15 consecutive nucleotides of any one of I', I" or I'"; and
  II') the nucleotide sequence of SEQ ID NO:4 (HAPLN3); or
  II") a nucleotide sequence being complementary to SEQ ID NO: 4; or
  II'") a nucleotide sequence having at least 90% sequence identity to any one of II' or II"; or
  II'"") a fragment of any one of II', II" or II'", wherein the fragment comprises at least 15 consecutive nucleotides of any one of I', I" or I'"; and III') the nucleotide sequence of SEQ ID NO:1 (AOX1); or
  III") a nucleotide sequence being complementary to SEQ ID NO: 1; or
  III'") a nucleotide sequence having at least 90% sequence identity to any one of III' or III'"; or
  III'"") a fragment of any one of III', III" or III'", wherein the fragment comprises at least 15 consecutive nucleotides of any one of III', III" or II'"; and
  IV') the nucleotide sequence of SEQ ID NO:2 (C1orf114); or
  IV") a nucleotide sequence being complementary to SEQ ID NO: 2; or
  IV'") a nucleotide sequence having at least 90% sequence identity to any one of IV' or IV"; or
  IV'"") a fragment of any one of IV', IV" or IV'", wherein the fragment comprises at least 15 consecutive nucleotides of any one of IV', IV" or IV'"; and
  V') the nucleotide sequence of SEQ ID NO:5 (ST6GALNAC3); or
  V") a nucleotide sequence being complementary to SEQ ID NO: 5; or
  V'") a nucleotide sequence having at least 90% sequence identity to any one of V' or V"; or
  V'"") a fragment of any one of V', V" or V'", wherein the fragment comprises at least 15 consecutive nucleotides of any one of V', V" or V'"; and
  VI') the nucleotide sequence of SEQ ID NO:6 (ZNF660); or
  VI") a nucleotide sequence being complementary to SEQ ID NO: 6; or
  VI'") a nucleotide sequence having at least 90% sequence identity to any one of VI' or VI'"; or
  VI'"") a fragment of any one of VI', VI" or VI'", wherein the fragment comprises at least 15 consecutive nucleotides of any one of VI', VI" or VI'";
c) comparing
  the methylation level, transcriptional level, and/or translational expression level of the sampled nucleotide sequence of b), with the corresponding methylation level, transcriptional level, and/or translational expression level of a corresponding nucleotide sequence of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

While the six genes may be used in common for diagnostic purposes, different combinations can be designed for specific purposes by the person of skill in the art based on the data presented e.g. in tables 15 and 16. The six genes identified by the present inventors may thus be arranged in panels and optimised for e.g. diagnostic or prognostic purposes respectively. Thus in one aspect, the invention concerns a method of determining if an individual has, or is at risk of developing prostate cancer, the method comprising the steps of:

a) providing a sample obtained from said individual;
b) determining in the sample of a),
  the methylation level, and/or
  the transcriptional expression level, and/or
  the translational expression level,
  of a panel comprising at least two nucleotide sequences, wherein the panel is selected from the group consisting of:
  i) C1orf114 (SEQ ID NO:2) and GAS6 (SEQ ID NO:3);
  ii) GAS6 (SEQ ID NO:3) and HAPLN3 (SEQ ID NO:4);

iii) C1orf114 (SEQ ID NO:2), GAS6 (SEQ ID NO:3) and HAPLN3 (SEQ ID NO:4);
iv) AOX1 (SEQ ID NO:1), C1orf114 (SEQ ID NO:2), GAS6 (SEQ ID NO:3) and HAPLN3 (SEQ ID NO:4);
v) AOX1'(SEQ ID NO:1), GAS6 (SEQ ID NO:3) and HAPLN3 (SEQ ID NO:4);
vi) AOX1 (SEQ ID NO:1), C1orf114 (SEQ ID NO:2) and GAS6 (SEQ ID NO:3);
vii) AOX1 (SEQ ID NO:1) and GAS6 (SEQ ID NO:3);
viii) C1orf114 (SEQ ID NO:2) and HAPLN3 (SEQ ID NO:4);
ix) AOX1 (SEQ ID NO:1), C1orf114 (SEQ ID NO:2) and HAPLN3 (SEQ ID NO:4);
x) AOX1 (SEQ ID NO:1) and HAPLN3 (SEQ ID NO:4);
xi) AOX1 (SEQ ID NO:1) and C1orf114 (SEQ ID NO:2);
xii) AOX1 (SEQ ID NO:1) and ST6GALNAC3 (SEQ ID NO:5);
xiii) AOX1 (SEQ ID NO:1) and ZNF660 (SEQ ID NO:6);
xiv) C1orf114 (SEQ ID NO:2) and ST6GALNAC3 (SEQ ID NO:5);
xv) C1orf114 (SEQ ID NO:2) and ZNF660 (SEQ ID NO:6);
xvi) GAS6 (SEQ ID NO:3) and ST6GALNAC3 (SEQ ID NO:5);
xvii) GAS6 (SEQ ID NO:3) and ZNF660 (SEQ ID NO:6);
xviii) HAPLN3 (SEQ ID NO:4) and ST6GALNAC3 (SEQ ID NO:5);
xix) HAPLN3 (SEQ ID NO:4) and ZNF660 (SEQ ID NO:6);
xx) S T6GALNAC3 (SEQ ID NO:5) and ZNF660 (SEQ ID NO:6);
xxi) AOX1 (SEQ ID NO:1), C1orf114 (SEQ ID NO:2) and ST6GALNAC3 (SEQ ID NO:5);
xxii) AOX1 (SEQ ID NO:1), C1orf114 (SEQ ID NO:2) and ZNF660 (SEQ ID NO:6);
xxiii) AOX1 (SEQ ID NO:1), GAS6 (SEQ ID NO:3) and ST6GALNAC3 (SEQ ID NO:5);
xxiv) AOX1 (SEQ ID NO:1), GAS6 (SEQ ID NO:3) and ZNF660 (SEQ ID NO:6);
xxv) AOX1 (SEQ ID NO:1), HAPLN3 (SEQ ID NO:4) and ST6GALNAC3 (SEQ ID NO:5);
xxvi) AOX1 (SEQ ID NO:1), HAPLN3 (SEQ ID NO:4) and ZNF660 (SEQ ID NO:6);
xxvii) AOX1 (SEQ ID NO:1), ST6GALNAC3 (SEQ ID NO:5) and ZNF660 (SEQ ID NO:6);
xxviii) C1orf114 (SEQ ID NO:2), GAS6 (SEQ ID NO:3) and ST6GALNAC3 (SEQ ID NO:5);
xxix) C1orf114 (SEQ ID NO:2), GAS6 (SEQ ID NO:3) and ZNF660 (SEQ ID NO:6);
xxx) C1orf114 (SEQ ID NO:2), HAPLN3 (SEQ ID NO:4) and ST6GALNAC3 (SEQ ID NO:5);
xxxi) C1orf114 (SEQ ID NO:2), HAPLN3 (SEQ ID NO:4) and ZNF660 (SEQ ID NO:6);
xxxii) C1orf114 (SEQ ID NO:2), ST6GALNAC3 (SEQ ID NO:5) and ZNF660 (SEQ ID NO:6);
xxxiii) GAS6 (SEQ ID NO:3), HAPLN3 (SEQ ID NO:4) and ST6GALNAC3 (SEQ ID NO:5);
xxxiv) GAS6 (SEQ ID NO:3), HAPLN3 (SEQ ID NO:4) and ZNF660 (SEQ ID NO:6);
xxxv) GAS6 (SEQ ID NO:3), ST6GALNAC3 (SEQ ID NO:5) and ZNF660 (SEQ ID NO:6);
xxxvi) HAPLN3 (SEQ ID NO:4), ST6GALNAC3 (SEQ ID NO:5) and ZNF660 (SEQ ID NO:6);
xxxvii) AOX1 (SEQ ID NO:1), C1orf114 (SEQ ID NO:2) and GAS6 (SEQ ID NO:3) and ST6GALNAC3 (SEQ ID NO:5);
xxxviii) AOX1 (SEQ ID NO:1), C1orf114 (SEQ ID NO:2) GAS6 (SEQ ID NO:3) and ZNF660 (SEQ ID NO:6);
xxxix) AOX1 (SEQ ID NO:1), C1orf114 (SEQ ID NO:2), HAPLN3 (SEQ ID NO:4),
xl) AOX1 (SEQ ID NO:1), C1orf114 (SEQ ID NO:2), HAPLN3 (SEQ ID NO:4), and ST6GALNAC3 (SEQ ID NO:5);
xli) AOX1 (SEQ ID NO:1), C1orf114 (SEQ ID NO:2), ST6GALNAC3 (SEQ ID NO:5) and ZNF660 (SEQ ID NO:6);
xlii) AOX1 (SEQ ID NO:1), GAS6 (SEQ ID NO:3), HAPLN3 (SEQ ID NO:4) and ST6GALNAC3 (SEQ ID NO:5);
xliii) AOX1 (SEQ ID NO:1), GAS6 (SEQ ID NO:3) and HAPLN3 (SEQ ID NO:4);
xliv) AOX1 (SEQ ID NO:1), GAS6 (SEQ ID NO:3) and ST6GALNAC3 (SEQ ID NO:5);
xlv) AOX1 (SEQ ID NO:1), HAPLN3 (SEQ ID NO:4), ST6GALNAC3 (SEQ ID NO:5) and ZNF660 (SEQ ID NO:6);
xlvi) C1orf114 (SEQ ID NO:2), GAS6 (SEQ ID NO:3), HAPLN3 (SEQ ID NO:4) and ST6GALNAC3 (SEQ ID NO:5);
xlvii) C1orf114 (SEQ ID NO:2), GAS6 (SEQ ID NO:3), HAPLN3 (SEQ ID NO:4) and ZNF660 (SEQ ID NO:6);
xlviii) C1orf114 (SEQ ID NO:2), GAS6 (SEQ ID NO:3), ST6GALNAC3 (SEQ ID NO:5) and ZNF660 (SEQ ID NO:6);
xlix) C1orf114 (SEQ ID NO:2), HAPLN3 (SEQ ID NO:4), ST6GALNAC3 (SEQ ID NO:5) and ZNF660 (SEQ ID NO:6);
l) GAS6 (SEQ ID NO:3), HAPLN3 (SEQ ID NO:4), ST6GALNAC3 (SEQ ID NO:5) and ZNF660 (SEQ ID NO:6);
li) AOX1 (SEQ ID NO:1), C1orf114 (SEQ ID NO:2), GAS6 (SEQ ID NO:3), HAPLN3 (SEQ ID NO:4) and ST6GALNAC3 (SEQ ID NO:5);
lii) AOX1 (SEQ ID NO:1), C1orf114 (SEQ ID NO:2), GAS6 (SEQ ID NO:3), HAPLN3 (SEQ ID NO:4) and ZNF660 (SEQ ID NO:6);
liii) AOX1 (SEQ ID NO:1), C1orf114 (SEQ ID NO:2), GAS6 (SEQ ID NO:3), ST6GALNAC3 (SEQ ID NO:5) and ZNF660 (SEQ ID NO:6);
liv) AOX1 (SEQ ID NO:1), C1orf114 (SEQ ID NO:2), HAPLN3 (SEQ ID NO:4), ST6GALNAC3 (SEQ ID NO:5) and ZNF660 (SEQ ID NO:6);
lv) AOX1 (SEQ ID NO:1), GAS6 (SEQ ID NO:3), HAPLN3 (SEQ ID NO:4), ST6GALNAC3 (SEQ ID NO:5) and ZNF660 (SEQ ID NO:6);
lvi) C1orf114 (SEQ ID NO:2), GAS6 (SEQ ID NO:3), HAPLN3 (SEQ ID NO:4),
lvii) ST6GALNAC3 (SEQ ID NO:5) and ZNF660 (SEQ ID NO:6); AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);
wherein any one of said SEQ ID NO: 1, 2, 3, 4, 5 or 6 of said panels i) through lvii) optionally is individually replaced by:
b') a nucleotide sequence being complementary to any one of said SEQ ID NOs: 1, 2, 3, 4, 5 or 6 of said panels i) through lvii); or
b") a nucleotide sequence having at least 90% sequence identity to any one of said SEQ ID NOs: 1, 2, 3, 4, 5 or 6 of said panels i) through lvii), or the complementary nucleotide sequences of b'); or b''') a fragment comprising at least 15 consecutive nucleotides of any one of said SEQ ID NOs: 1, 2, 3, 4, 5 or 6 of said panels i) through lvii), or the nucleotide sequences of b'), or the nucleotide sequences of b'');

c) comparing the methylation level, transcriptional level, and/or translational expression level of the sampled nucleotide sequences of b), with the corresponding methylation level, transcriptional level, and/or translational expression level of a corresponding nucleotide sequences of a control sample, wherein a methylation level being significantly higher than the methylation level of the control sample, and/or a transcriptional and/or a translational expression level being significantly lower than the transcriptional level of the control sample, is indicative of that the individual has, or is at risk of developing prostate cancer.

As mentioned above, panels of different combinations of genes have been designed and, wherein each panel is suitable for a particular purpose. One such purpose is to prognosing, i.e. determining disease progression of prostate cancer. Thus in one important aspect the invention concerns a method for prognosing disease progression of prostate cancer in a patient, said method comprising the steps of:

a) providing a sample obtained from cancerous tissue of an individual;

b) determining in the sample of a),
the methylation level, and/or
the transcriptional expression level, and/or
the translational expression level,
of a panel comprising one or more nucleotide sequences, wherein the panel is selected from the group consisting of:

i) C1orf114 (SEQ ID NO:2) and HAPLN3 (SEQ ID NO:4);
ii) AOX (SEQ ID NO:1) and C1orf114 (SEQ ID NO:2);
iii) AOX (SEQ ID NO:1), C1orf114 (SEQ ID NO:2) and GAS6 (SEQ ID NO:3);
iv) C1orf114 (SEQ ID NO:2), GAS6 (SEQ ID NO:3) and HAPLN3 (SEQ ID NO:4);
v) C1orf114 (SEQ ID NO:2);
vi) AOX (SEQ ID NO:1), C1orf114 (SEQ ID NO:2) and HAPLN3 (SEQ ID NO:4);
vii) AOX (SEQ ID NO:1), C1orf114 (SEQ ID NO:2), GAS6 (SEQ ID NO:3) and HAPLN3 (SEQ ID NO:4);
viii) C1orf114 (SEQ ID NO:2) and GAS6 (SEQ ID NO:3);
ix) AOX (SEQ ID NO:1) and GAS6 (SEQ ID NO:3);
x) AOX (SEQ ID NO:1);
xi) HAPLN3 (SEQ ID NO:4);
xii) AOX (SEQ ID NO:1) and HAPLN3 (SEQ ID NO:4);
xiii) AOX (SEQ ID NO:1), GAS6 (SEQ ID NO:3) and HAPLN3 (SEQ ID NO:4);
xiv) GAS6 (SEQ ID NO:3) and HAPLN3 (SEQ ID NO:4);
xv) GAS6 (SEQ ID NO:3);
xvi) ST6GALNAC3 (SEQ ID NO:5);
xvii) ZNF660 (SEQ ID NO:6);
xviii) AOX (SEQ ID NO:1) and ST6GALNAC3 (SEQ ID NO:5);
xix) AOX (SEQ ID NO:1) and ZNF660 (SEQ ID NO:6);
xx) C1orf114 (SEQ ID NO:2) and ST6GALNAC3 (SEQ ID NO:5);
xxi) C1orf114 (SEQ ID NO:2) and ZNF660 (SEQ ID NO:6);
xxii) GAS6 (SEQ ID NO:3) and ST6GALNAC3 (SEQ ID NO:5);
xxiii) GAS6 (SEQ ID NO:3) and ZNF660 (SEQ ID NO:6);
xxiv) HAPLN3 (SEQ ID NO:4) and ST6GALNAC3 (SEQ ID NO:5);
xxv) HAPLN3 (SEQ ID NO:4) and ZNF660 (SEQ ID NO:6);
xxvi) ST6GALNAC3 (SEQ ID NO:5) and ZNF660 (SEQ ID NO:6);
xxvii) AOX (SEQ ID NO:1), C1orf114 (SEQ ID NO:2) and ST6GALNAC3 (SEQ ID NO:5);
xxviii) AOX (SEQ ID NO:1), C1orf114 (SEQ ID NO:2) and ZNF660 (SEQ ID NO:6);
xxix) AOX (SEQ ID NO:1), GAS6 (SEQ ID NO:3) and ST6GALNAC3 (SEQ ID NO:5);
xxx) AOX (SEQ ID NO:1), GAS6 (SEQ ID NO:3) and ZNF660 (SEQ ID NO:6);
xxxi) AOX (SEQ ID NO:1), HAPLN3 (SEQ ID NO:4) and ST6GALNAC3 (SEQ ID NO:5);
xxxii) AOX (SEQ ID NO:1), HAPLN3 (SEQ ID NO:4) and ZNF660 (SEQ ID NO:6);
xxxiii) AOX (SEQ ID NO:1), ST6GALNAC3 (SEQ ID NO:5) and ZNF660 (SEQ ID NO:6);
xxxiv) C1orf114 (SEQ ID NO:2), GAS6 (SEQ ID NO:3) and ST6GALNAC3 (SEQ ID NO:5);
xxxv) C1orf114 (SEQ ID NO:2), GAS6 (SEQ ID NO:3) and ZNF660 (SEQ ID NO:6);
xxxvi) C1orf114 (SEQ ID NO:2), HAPLN3 (SEQ ID NO:4) and ST6GALNAC3 (SEQ ID NO:5);
xxxvii) C1orf114 (SEQ ID NO:2), HAPLN3 (SEQ ID NO:4) and ZNF660 (SEQ ID NO:6);
xxxviii) C1orf114 (SEQ ID NO:2), ST6GALNAC3 (SEQ ID NO:5) and ZNF660 (SEQ ID NO:6);
xxxix) GAS6 (SEQ ID NO:3), HAPLN3 (SEQ ID NO:4) and ST6GALNAC3 (SEQ ID NO:5);
xl) GAS6 (SEQ ID NO:3), HAPLN3 (SEQ ID NO:4) and ZNF660 (SEQ ID NO:6);
xli) GAS6 (SEQ ID NO:3), ST6GALNAC3 (SEQ ID NO:5) and ZNF660 (SEQ ID NO:6);
xlii) HAPLN3 (SEQ ID NO:4), ST6GALNAC3 (SEQ ID NO:5) and ZNF660 (SEQ ID NO:6);
xliii) AOX (SEQ ID NO:1), C1orf114 (SEQ ID NO:2), GAS6 (SEQ ID NO:3) and ST6GALNAC3 (SEQ ID NO:5);
xliv) AOX (SEQ ID NO:1), C1orf114 (SEQ ID NO:2), GAS6 (SEQ ID NO:3) and ZNF660 (SEQ ID NO:6);
xlv) AOX (SEQ ID NO:1), C1orf114 (SEQ ID NO:2), HAPLN3 (SEQ ID NO:4) and ST6GALNAC3 (SEQ ID NO:5);
xlvi) AOX (SEQ ID NO:1), C1orf114 (SEQ ID NO:2), HAPLN3 (SEQ ID NO:4) and ZNF660 (SEQ ID NO:6);
xlvii) AOX (SEQ ID NO:1), C1orf114 (SEQ ID NO:2), ST6GALNAC3 (SEQ ID NO:5) and ZNF660 (SEQ ID NO:6);
xlviii) AOX (SEQ ID NO:1), GAS6 (SEQ ID NO:3), HAPLN3 (SEQ ID NO:4) and ST6GALNAC3 (SEQ ID NO:5);
xlix) AOX (SEQ ID NO:1), GAS6 (SEQ ID NO:3), HAPLN3 (SEQ ID NO:4) and ZNF660 (SEQ ID NO:6);
l) AOX (SEQ ID NO:1), GAS6 (SEQ ID NO:3), ST6GALNAC3 (SEQ ID NO:5) and ZNF660 (SEQ ID NO:6);

lxi) AOX (SEQ ID NO:1), HAPLN3 (SEQ ID NO:4), ST6GALNAC3 (SEQ ID NO:5) and ZNF660 (SEQ ID NO:6);

lii) C1orf114 (SEQ ID NO:2), GAS6 (SEQ ID NO:3), HAPLN3 (SEQ ID NO:4) and ST6GALNAC3 (SEQ ID NO:5);

liii) C1orf114 (SEQ ID NO:2), GAS6 (SEQ ID NO:3), HAPLN3 (SEQ ID NO:4) and ZNF660 (SEQ ID NO:6);

liv) C1orf114 (SEQ ID NO:2), GAS6 (SEQ ID NO:3), ST6GALNAC3 (SEQ ID NO:5) and ZNF660 (SEQ ID NO:6);

lv) C1orf114 (SEQ ID NO:2), HAPLN3 (SEQ ID NO:4), ST6GALNAC3 (SEQ ID NO:5) and ZNF660 (SEQ ID NO:6);

lvi) GAS6 (SEQ ID NO:3), HAPLN3 (SEQ ID NO:4), ST6GALNAC3 (SEQ ID NO:5) and ZNF660 (SEQ ID NO:6);

lvii) AOX (SEQ ID NO:1), C1orf114 (SEQ ID NO:2), GAS6 (SEQ ID NO:3), HAPLN3 (SEQ ID NO:4) and ST6GALNAC3 (SEQ ID NO:5);

lviii) AOX (SEQ ID NO:1), C1orf114 (SEQ ID NO:2), GAS6 (SEQ ID NO:3), HAPLN3 (SEQ ID NO:4) and ZNF660 (SEQ ID NO:6);

lix) AOX (SEQ ID NO:1), C1orf114 (SEQ ID NO:2), GAS6 (SEQ ID NO:3), ST6GALNAC3 (SEQ ID NO:5) and ZNF660 (SEQ ID NO:6);

lx) AOX (SEQ ID NO:1), C1orf114 (SEQ ID NO:2), HAPLN3 (SEQ ID NO:4), ST6GALNAC3 (SEQ ID NO:5) and ZNF660 (SEQ ID NO:6);

lxi) AOX (SEQ ID NO:1), GAS6 (SEQ ID NO:3), HAPLN3 (SEQ ID NO:4), ST6GALNAC3 (SEQ ID NO:5) and ZNF660 (SEQ ID NO:6);

lxii) C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);

lxiii) AOX (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6);

wherein any one of said SEQ ID NO: 1, 2, 3, 4, 5 or 6 of said panels i) through lxiii) optionally is individually replaced by:

b') a nucleotide sequence being complementary to any one of said SEQ ID NOs: 1, 2, 3, 4, 5 or 6 of said panels i) through lvii); or b") a nucleotide sequence having at least 90% sequence identity to any one of said SEQ ID NOs: 1, 2, 3, 4, 5 or 6 of said panels i) through lvii), or the complementary nucleotide sequences of b'); or b''') a fragment comprising at least 15 consecutive nucleotides of any one of said SEQ ID NOs: 1, 2, 3, 4, 5 or 6 of said panels i) through lvii), or the nucleotide sequences of b'), or the nucleotide sequences of b");

c) obtaining a biomarker score based on the methylation level, transcriptional level, and/or translational expression level of the sampled nucleotide sequence of b), wherein the biomarker score is indicative of the prognosis of the prostate cancer patient.

PSA (Prostate Specific Antigen) is a protein produced by both normal and cancerous prostate cells. A PSA level of 3 ng/mL or less is considered to be in the normal range for a man under 60 years old, whereas 4 ng/mL or less is normal for a man aged 60 to 69 years. A PSA level of 5 ng/mL or less is normal if you are aged over 70.

In one embodiment the individual as described in the methods of the present invention has a normal prostate specific antigen (PSA) level. In another embodiment the individual as described in the methods of the present invention has a PSA level higher than a normal PSA level. It is preferred that a normal PSA level is a PSA level of at the most 3 ng per mL serum.

Tumour recurrence is often measured by increased levels of PSA defined as PSA level greater than or equal to 0.1 ng/mL serum measured at least one month after for example surgery. Individuals having PSA levels above 0.1 ng/mL serum measured less than 1 month after surgery, are not considered to suffer from reoccurrence but rather an indication that the primary tumour was not removed, for example in the event of advanced cancer at the time of surgery. In rare cases metastases are detected without an increase in PSA level.

The AOX1, C1orf114, GAS6, HAPLN3, ST6GALNAC3 and/or ZNF660 markers of the present invention may for example be used in combination with PSA measurements. Thus, the method for assisting in diagnosing and/or for diagnosing prostate cancer in an individual and/or for assisting in prognosing and/or for prognosing the disease progression of prostate cancer in an individual having developed prostate cancer and/or for assisting in predicting and/or for predicting the outcome of prostate cancer in an individual having developed prostate cancer and/or for assisting in monitoring and/or for monitoring the effect of treatment on prostate cancer progression in an individual having developed prostate cancer and being treated for said prostate cancer and/or for assisting in monitoring and/or for monitoring the progression of prostate cancer from a silent/indolent to an aggressive prostate cancer in an individual having developed prostate cancer and/or for assisting in determining and/or determining the treatment regime of an individual having developed prostate cancer may further comprise determining the PSA level.

It has been shown that hypomethylation of TFF3 and hypermethylation of SLC18A2 is indicative of the presence of prostate cancer (US 2010/0303795). Furthermore, a decrease in the transcriptional and/or translational level of SLC18A2, whereas an increase in transcriptional and/or translational level of TFF3 is indicative of the presence of prostate cancer.

Thus, the methods of the present invention may further comprise a step of determining the methylation degree and/or methylation incidence and/or translational level and/or transcriptional level of at least one of the genes selected from the group comprising TFF3 and SLC18A2.

The methods of the present invention may further comprise a step of determining the methylation degree and/or methylation incidence and/or translational level and/or transcriptional level of at least one of the genes selected from the group comprising KLF8 and MOB3B (previously known as MOBKL2B).

The methods of the present invention may further comprise a step of determining the methylation degree and/or methylation incidence and/or translational level and/or transcriptional level of at least one of the genes selected from the group comprising GABRE, TFF3, ZNF132, PCA3, GSTP1, PITX2 and SLC18A2.

Computer Implemented Methods

In certain embodiments it is advantageous to perform the methods under the control of a computer. Thus in one aspect the invention concerns a system for predicting the prognosis of an individual with prostate cancer, comprising:

a) means for analysing the methylation level, transcriptional level, and/or translational expression levels of one or more biomarkers in a sample obtained from said individual, and b) means for estimating the probability for a patient with prostate cancer of surviving for a certain period of time, wherein said biomarker comprises one or more nucleotide sequences selected from the group consisting of:

I') the nucleotide sequence of SEQ ID NO:1 (AOX1); or

I") a nucleotide sequence being complementary to SEQ ID NO: 1; or

I'") a nucleotide sequence having at least 90% sequence identity to any one of I' or I"; or I"") a fragment of any one of I', I" or I'", wherein the fragment comprises at least 15 consecutive nucleotides of any one of I', I" or I'"; and II') the nucleotide sequence of SEQ ID NO:2 (C1orf114); or II") a nucleotide sequence being complementary to SEQ ID NO: 2; or II'") a nucleotide sequence having at least 90% sequence identity to any one of II' or II"; or II"") a fragment of any one of II', II" or II'", wherein the fragment comprises at least 15 consecutive nucleotides of any one of I', I" or I'"; and III') the nucleotide sequence of SEQ ID NO:3 (GAS6); or III") a nucleotide sequence being complementary to SEQ ID NO: 3; or III'") a nucleotide sequence having at least 90% sequence identity to any one of III' or II'"; or III"") a fragment of any one of III', III" or III'", wherein the fragment comprises at least 15 consecutive nucleotides of any one of III', III" or III'"; and IV') the nucleotide sequence of SEQ ID NO:4 (HAPLN3); or IV") a nucleotide sequence being complementary to SEQ ID NO: 4; or IV'") a nucleotide sequence having at least 90% sequence identity to any one of IV' or IV"; or IV"") a fragment of any one of IV', IV" or IV'", wherein the fragment comprises at least 15 consecutive nucleotides of any one of IV', IV" or IV'"; and V') the nucleotide sequence of SEQ ID NO:5 (ST6GALNAC3 (SEQ ID NO:5)); or V") a nucleotide sequence being complementary to SEQ ID NO: 5; or V'") a nucleotide sequence having at least 90% sequence identity to any one of V' or V"; or V"") a fragment of any one of V', V" or V'", wherein the fragment comprises at least 15 consecutive nucleotides of any one of V', V" or V'"; and VI') the nucleotide sequence of SEQ ID NO:6 (ZNF660); or VI") a nucleotide sequence being complementary to SEQ ID NO: 6; or VI'") a nucleotide sequence having at least 90% sequence identity to any one of VI' or VI"; or VI"") a fragment of any one of VI', VI" or VI'", wherein the fragment comprises at least 15 consecutive nucleotides of any one of VI', VI" or VI'".

In one aspect the invention concerns a computer program product having a computer readable medium, said computer program product providing a system for predicting the prognosis of an individual, said computer program product comprising means for carrying out any of the steps of any of the methods defined herein.

In one aspect the invention concerns a method for predicting a probability of recurrence of prostate cancer in a patient following radical prostatectomy, comprising: correlating a set of pre-operative factors for the patient to a functional representation of a set of pre-operative factors determined for each of a plurality of persons previously diagnosed with prostatic cancer and having been treated by radical prostatectomy, so as to yield a value for total points for the patient, which set of factors for each of a plurality of persons is correlated with the incidence of recurrence of prostatic cancer for each person in the plurality of persons, wherein the set of pre-operative factors comprises pre-treatment methylation level, transcriptional level, and/or translational expression levels of one or more genes selected from the group consisting of: C1orf114 (SEQ ID NO:2), HAPLN3 (SEQ ID NO:4), AOX1 (SEQ ID NO: 1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade, wherein the functional representation comprises a scale for each of pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally a scale for one or more of pre-treatment PSA level, primary Gleason grade or secondary Gleason grade, a points scale, a total points scale, and a predictor scale, wherein the scales for pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade, each have values on the scales which can be correlated with values on the points scale, and wherein the total points scale has values which may be correlated with values on the predictor scale; and b) correlating the value on the total points scale for the patient with a value on the predictor scale to predict the quantitative probability of recurrence of prostatic cancer in the patient following radical prostatectomy.

In one aspect the invention concerns an apparatus for predicting a probability of disease recurrence in a patient with prostate cancer following a radical prostatectomy, which apparatus comprises: a) a correlation of a set of pre-operative factors for each of a plurality of persons previously diagnosed with prostatic cancer and having been treated by radical prostatectomy with the incidence of recurrence of prostatic cancer for each person of the plurality of persons, wherein the set of pre-operative factors comprises pre-treatment methylation level, transcriptional level, and/or translational expression levels of one or more genes selected from the group consisting of C1orf114 (SEQ ID NO:2), HAPLN3 (SEQ ID NO:4), AOX1 (SEQ ID NO:1), GAS6 (SEQ ID NO:3), ST6GALNAC3 (SEQ ID NO:5) and ZNF660 (SEQ ID NO:6), and optionally one or more of pre-treatment PSA level, primary Gleason grade or secondary Gleason grade; and b) a means for comparing an identical set of pre-operative factors determined from a patient diagnosed as having prostate cancer to the correlation to predict the quantitative probability of recurrence of prostate cancer in the patient following radical prostatectomy.

As in the case of non-computer implemented methods, the methylation level is selected from methylation degree and/or methylation incidence.

Kit

According to another aspect of the present invention, it provides a kit (assay) useful for detecting prostate cancer and various aspects of prostate cancer, e.g., using the methods disclosed herein.

In one embodiment the kit comprises means for determining the methylation level and/or methylation incidence of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) or nucleotide sequence having at least 90% sequence identity with a nucleotide sequence selected from the group consisting of SEQ ID NO:1, SEQ ID NO:2, SEQ ID NO:3, SEQ ID NO:4, SEQ ID NO:5 and SEQ ID NO:6, or part thereof.

In one embodiment, the present invention provides a kit, e.g., a compartmentalized carrier including a first container containing a pair of primers for amplification of a region of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6), optionally a second container containing a pair of primers for amplification of a region in a reference gene, and a third container containing a first and second oligonucleotide probe specific for the amplification of the test gene and the region of the reference gene, respectively.

The region of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) comprises at least one CpG site of interest. In a preferred embodiment the at least one CpG site is comprised in the regions or gene sequences as defined in the section "Determining the methylation degree and the methylation incidence".

In another embodiment, the kit provided by the present invention further includes a fourth container containing a modifying agent that modifies unmethylated cytosine to produce a converted nucleic acid, e.g., uracil. Any suitable modifying agent, such as an agent that modifies unmethylated cytosine nucleotides, can be included in the kit provided by the present invention. For example, the modifying agent can be sodium bisulfite.

The kit may also comprise additional reagents used in the amplifying step of the detection method as disclosed herein. Thus, the kit may further comprise deoxyribonucleoside triphosphates, DNA polymerase enzyme and/or nucleic acid amplification buffer.

The kit may in preferred embodiments further comprise instructions for the performance of the detection method of the kit and for the interpretation of the results. The kit involves the method of detecting the methylation status of a CpG-containing nucleic acid, wherein said CpG-containing nucleic acids is modified using an agent which modifies at least one unmethylated cytosine in said methylated CpG-containing nucleic acid and amplifying said CpG-containing nucleic acid by means of at least one methylation-independent oligonucleotide primer. The instructions for performing the method of the kit comprises for example information of particular annealing temperatures to be used for the at least one methylation-independent primers, as well as for example information on cycling parameters. The kit may further comprise instructions for the interpretation of the results obtained by the method. For example how to interpret the amplified products subsequently analysed by high resolution melting analysis or methods as described elsewhere herein. For example the kit in one embodiment comprises means for providing a methylation level and/or means for providing information as to determine whether the level of methylation is above or below a cut off value. However, the assay in another embodiment comprises means for providing a transcriptional and/or translational expression level, and/or means for providing information as to determine whether the level of expression is above or below a cut off value.

The kit may in preferred embodiments further comprise software comprising an algorithm for calculation of primer annealing temperature and interpretation of results.

In yet another embodiment, the kit provided by the present invention further includes a probe for PSA determination. In still another embodiment, the kit provided by the present invention further includes an instruction insert disclosing normal and/or abnormal methylation ratio ranges for the detection of neoplasia, describing the types of samples suitable or unsuitable for the application of the kit, and/or the specificity or sensitivity provided by the assays utilizing the kit of the present invention.

The present invention also provides a kit useful for detecting prostate adenocarcinoma, for example in body fluid samples. The kit includes a first container containing at least one pair of primers capable of distinguishing between methylated and unmethylated nucleic acid for amplification of a region of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) and an instruction insert disclosing, among other things, that the kit is useful for detecting prostate cancer in a body fluid sample of an individual and that a methylation level of the region of at least one gene selected from the group consisting of AOX1 (SEQ ID NO:1), C1orf114 (SEQ ID NO:2), GAS6 (SEQ ID NO:3), HAPLN3 (SEQ ID NO:4), ST6GALNAC3 (SEQ ID NO:5) and ZNF660 (SEQ ID NO:6) as determined by conventional or non-real-time PCR using the primers provided that is higher than the methylation level of said region in a normal subject is indicative of prostate cancer in the subject.

For example the kit in one embodiment comprises means for providing a methylation level and/or means for providing information as to determine whether the level of methylation is above or below a cut off value, and thus indicative of the presence or absence of prostate cancer, respectively.

The kit may comprise a plurality of oligonucleotides for use in determining the expression level of a panel of genes. Thus in one aspect the invention concerns use of a plurality of oligonucleotides for determining the expression level of a panel of genes, where said panel comprises two or more biomarkers selected from:

I') the nucleotide sequence of SEQ ID NO:1 (AOX1); or

I") a nucleotide sequence being complementary to SEQ ID NO: 1; or

I''') a nucleotide sequence having at least 90% sequence identity to any one of I' or I"; or I'''') a fragment of any one of I', I" or I''', wherein the fragment comprises at least 15 consecutive nucleotides of any one of I', I" or I'''; and II') the nucleotide sequence of SEQ ID NO:2 (C1orf114); or II") a nucleotide sequence being complementary to SEQ ID NO: 2; or II''') a nucleotide sequence having at least 90% sequence identity to any one of II' or II"; or II'''') a fragment of any one of II', II" or II''', wherein the fragment comprises at least 15 consecutive nucleotides of any one of I', I" or I'''; and III') the nucleotide sequence of SEQ ID NO:3 (GAS6); or III") a nucleotide sequence being complementary to SEQ ID NO: 3; or III''') a nucleotide sequence having at least 90% sequence identity to any one of III' or III''; or III'''') a fragment of any one of III', II'' or III''', wherein the fragment comprises at least 15 consecutive nucleotides of any one of III', III'' or III'''; and IV') the nucleotide sequence of SEQ ID NO:4 (HAPLN3); or IV'') a nucleotide sequence being complementary to SEQ ID NO: 4; or IV''') a nucleotide sequence having at least 90% sequence identity to any one of IV' or IV''; or IV'''') a fragment of any one of IV', IV'' or IV''', wherein the fragment comprises at least 15 consecutive nucleotides of any one of IV', IV'' or IV'''; and V') the nucleotide sequence of SEQ ID NO:5 (ST6GALNAC3 (SEQ ID NO:5)); or V'') a nucleotide sequence being complementary to SEQ ID NO: 5; or V''') a nucleotide sequence having at least 90% sequence identity to any one of V' or V''; or V'''') a fragment of any one of V', V'' or V''', wherein the fragment comprises at least 15 consecutive nucleotides of any one of V', V'' or V'''; and VI') the nucleotide sequence of SEQ ID NO:6 (ZNF660); or VI'') a nucleotide sequence being complementary to SEQ ID NO: 6; or VI''') a nucleotide sequence having at least 90% sequence identity to any one of VI' or VI''; or VI'''') a fragment of any one of VI', VI'' or VI''', wherein the fragment comprises at least 15 consecutive nucleotides of any one of VI', VI'' or VI'''.

In one embodiment the oligonucleotides are for use in the manufacture of a diagnostic product for determining the prognosis or likelihood of recurrence of prostate cancer in an individual.

EXAMPLES

Materials and Methods
Cell Lines

Human prostate cancer (PC) cell lines LNCaP, DU145 (obtained from American Type Culture Collection) and BPH1 (obtained from the German Collection of Microorganisms and Cell Cultures) were cultured in RPMI 1640 with L-glutamin (Gibco, Invitrogen) supplemented with 10% fetal bovine serum and 100 U/ml penicillin and 100 µg/ml streptomycin. Cell line identity was verified by STR analysis (IdentiCell).

Patient Material

Samples used for 27K Infinium Analysis: Nine adjacent normal (ADJ-N) and five clinically localized PC (radical prostatectomies (RPs)) tissue samples were obtained by careful macrodissection of 20-µm sections of fresh-frozen tissue-tek-embedded prostate needle biopsies taken immediately after radical prostatectomy. Four samples of primary tumours from metastatic PCs were obtained from transurethral resection specimens of the prostate (TURP). Biopsy and TURP were performed by the Urology Department, Aarhus University Hospital, Denmark.

Samples used for bisulfite sequencing (BS): Five ADJ-N, ten RP and ten MPC samples were obtained as described above. Six benign prostatic hyperplasias (BPHs) samples were obtained from TURP specimens.

Cohort 1: Radical prostatectomy cohort consisting of 293 RP, 26 RP with endocrine treatment, 18 ADJ-N, 15 BPH, 11 high-grade prostate intraepithelial neoplasia (PIN), 17 MPC and 28 castrate refractory PC (CRPC) samples (clinicopathological data in table 4 and table 5). RP, ADJ-N and PIN samples originated from radical prostatectomy specimens. BPH, MPC and CRPC samples originated from TURP specimens. Radical prostatectomies/TURPs were performed from 1993-2005 at Aarhus University Hospital, Denmark and University Hospital Zurich, Switzerland. Cohort 1 was originally used for construction of TMAs, tissue collection and characterization is described in Sorensen et al., 2009 (Sorensen, K. D., et al., Genetic and epigenetic SLC18A2 silencing in prostate cancer is an independent adverse predictor of biochemical recurrence after radical prostatectomy, Clin Cancer Res, 2009, 15(4): p. 1400-10). For DNA purification, FFPE blocks were biopsied (1.5 mm) next to the original cores used for the TMAs. Samples of lymph node metastases and of patients having received pre- or postoperative therapy were excluded. We originally sampled 532 FFPE blocks, but upon DNA quality control 124 samples failed resulting in the final cohort.

Cohort 2 (validation): Radical prostatectomy cohort consisting of 114 RP samples (clinicopathological data in table 4). Radical prostatectomies were performed from 1993-2002 at Department of Urology, Heinrich Heine University, Duesseldorf, Germany and from 1992-2003 at Department of Urology, Tampere University Hospital, Finland. For German samples tissue collection and characterization is described in Florl et al., 2004 (Florl, A. R., et al., Coordinate hypermethylation at specific genes in prostate carcinoma precedes LINE-1 hypomethylation. Br J Cancer, 2004. 91(5): p. 985-94). Of the original German samples we analyzed a subset for which DNA and complete follow-up was available as described in Schulz, W. A., et al 2007 (Schulz, W. A., et al., Factor interaction analysis for chromosome 8 and DNA methylation alterations highlights innate immune response suppression and cytoskeletal changes in prostate cancer. Mol Cancer, 2007. 6: p. 14). For both German and Finnish samples, a trained pathologist dissected the prostate immediately after RP and tumor samples were snap-frozen. Based on H&E stained sections, DNA was extracted from fresh-frozen samples with >70% tumor content. We originally analyzed 117 samples, but upon DNA quality control 3 samples failed resulting in the final cohort.

DNA Purification and Bisulfite Conversion

Genomic DNA used for Infinium analysis and for bisulfite sequencing (BS) was purified from tissue samples and cell lines using the Qiagen Gentra Puregene Blood Kit with proteinase K treatment (100 U, 30 min at 55° C.) and converted using the Qiagen EpiTect® kit. DNA from FFPE samples was purified as previously described (Sørensen, K. D., et al., Prognostic significance of aberrantly silenced ANPEP expression in prostate cancer. Br J Cancer, 2013. 108: p. 420), while cell line DNA used for qMSP was purified using the Macherey-Nagel Nucleospin kit and bisulfite converted using the EZ-96 DNA Methylation-Gold Kit™ from Zymo as described in manual.

For cohort 2, DNA extraction was conducted in Germany and Finland using the blood and cell culture DNA kit (Qiagen) (Florl, A. R., et al., Coordinate hypermethylation at specific genes in prostate carcinoma precedes LINE-1 hypomethylation. Br J Cancer, 2004. 91(5): p. 985-94), and the AllPrep Mini DNA/RNA kit (Qiagen), respectively.

Infinium Methylation Analysis

A total of 1 µg DNA was bisulfite converted, whole genome amplified and applied to Illumina's Infinium 27k Human DNA methylation Beadchip v1.2. These analyses were conducted by AROS Applied Biotechnology A/S, Aarhus, Denmark.

Bisulfite Sequencing

Bisulfite sequencing was performed as previously described in Abildgaard et al. 2011 and Vestergaard et al., 2010 (Abildgaard, M. O., et al., Downregulation of zinc finger protein 132 in prostate cancer is associated with aberrant promoter hypermethylation and poor prognosis. Int J Cancer, 2011; Vestergaard, E. M., et al., Promoter hypomethylation and upregulation of trefoil factors in prostate cancer. Int J Cancer, 2010. 127(8): p. 1857-65). Briefly: Primers (suppl table 2), designed using Methprimer (Li, L. C. and R. Dahiya, MethPrimer: designing primers for methylation PCRs. Bioinformatics, 2002. 18(11): p. 1427-31), were used to amplify bisulfite converted DNA. Gel purified PCR products were cloned using the TOPO® TA Cloning® Kit for Sequencing (Invitrogen). Several single colonies were picked, PCR amplified and sequenced. All sequences were manually inspected for C/T status of each CpG site. Results were visualized and analyzed in QUMA (Kumaki, Y., M. Oda, and M. Okano, QUMA: quantification tool for methylation analysis. Nucleic Acids Res, 2008. 36(Web Server issue): p. W170-5). Sequences with <95% bisulfite conversion were excluded from further analysis. For each gene in each sample the overall methylation frequency (methylated CpG sites/all CpG sites) as well as the methylation frequency of the most methylated sequence was calculated.

Methylation Specific qPCR (qMSP)

qMSP assays (suppl table 2) were designed using NetPrimer and Beacon Designer™ (Premier Biosoft) Primer3 (Rozen, S., Skaletsky, H. J., Primer3. Code available at http://www-genome.wi.mit.edulgenome_software/other/primer3.html) and PrimerquestSM (Integrated DNA Technologies) and were optimized on bisulfite converted CpGenome Universal Methylated and Unmethylated DNA (Millipore) using Taqman Universal Mastermix NO UNG. MYOD1 (reference gene) primer set was from (Jeronimo, C., et al., Quantitation of GSTP1 methylation in non-neoplastic prostatic tissue and organ-confined prostate adenocarcinoma. J Natl Cancer Inst, 2001. 93(22): p. 1747-52).

Patient DNA was analyzed in triplicate and cell line DNA was analyzed three times in duplicate using 5 ng bisulfite converted DNA per reaction. DNA and mastermix were pippeted using the Biomek 3000 robot (Beckman Coulter) and run on Applied Biosystem's 7900HT real-time thermal cycler in 384 well plates. Reaction conditions in suppl table 2. Bisulfite converted and un-converted methylated and un-methylated DNA and a standard curve of methylated DNA was included on each plate. Samples were excluded from further analysis if ⅔ MYOD1 Ct values exceeded 36. Outliers >2 Cts lower/higher than the other Ct values were removed prior to analysis. Samples were considered negative for methylation if ≥2 reactions failed.

5-aza-dC Treatment, RNA Extraction, and RT-qPCR

BPH1, PNT1A, LNCaP, 22rv1, PC3 and DU145 cell lines at >50% confluence were treated with 1 µM freshly prepared 5-aza-2'-deoxycytidine (5-aza-dC) in 50% acetic acid (Sigma, cat. no.: A3656) for two days. After a five day recovery period, DNA was purified as described above. RNA was purified using the RNeasy Mini kit from Qiagen and stored at −80° C. One µg RNA was reverse transcribed using 100 pmol oligo-dT(24) primer and the SuperScript II Reverse Transcriptase kit (Invitrogen). Taqman® gene expression assays: AOX1 (Hs01565232_m1), C1orf114 (Hs00982321_g1), GAS6 (Hs01090305_m1), and HAPLN3 (Hs00820260_m1) were used with Taqman Mastermix no UNG. UBC was used for normalization (primers: 5'-GATTTGGGTCGCGGTTCTT-3' and 5'-TGCCTTGACATTCTCGATGGT-3' used with Power Sybr Green Mastermix). Assays were run twice in triplicate in 10 µL reactions. Reactions were mixed and run as described for qMSP assays.

Chromatin Immunoprecipitation (ChIP)

ChIP was performed using the MAGnify™ Chromatin Immunoprecipitation System (Invitrogen) as described by the manufacturer. 3×106 cells were seeded, and after two days crosslinked directly in the flasks or dishes with 1% formaldehyde (Calbiochem), harvested and stored at −80° C. To shear the chromatin to 100-500 bp fragments, cell samples were transferred to microTUBEs (Covaris®) and fragmented on the Covaris® S2 system (settings: Duty cycle: 20%; Cycles per burst: 200; Intensity: 5; Time: 300 sec; Temperature (water bath): 4° C.; Power mode: Frequency sweeping; Degassing mode: continuous). Two µl were withdrawn, Proteinase K-treated and run (5 µl of a 1:10 dilution) on a 2% agarose gel to verify fragment sizes. Sheared chromatin was saved as aliquots in the −80° C. freezer. The immunoprecipitation was performed three independent times with three antibodies per cell line: 1 µl unspecific rabbit IgG antibody provided in the kit, 1 µl H3K4me3-specific antibody (Ab8580, Abcam), 5 µl H3K27me3-specific antibody (M07-449, Millipore). Incubation between antibody-bound beads and chromatin extract was performed o/n at 4° C. Purified DNA was stored at −20° C. Primers (Table 14) for quantification of histone trimethylations at candidate genes, GAPDH and COL2A1 (positive controls for H3K4me3 and H3K27me3, respectively) were designed using Primer3 (Rozen, S., Skaletsky, H. J., Primer3. Code available at http://www-genome.wi.mit.edu/genome_software/other/primer3.html). Reactions were pippeted and run as described for qMSP assays. Each reaction was run in triplicate on 2 µl IP'ed or input DNA (10× dilutions compared to the IP'ed samples). No-template controls and standard curves based on DU145 cell line DNA independent of the three ChIP experiments were included on each plate. Outliers >1 Ct lower/higher than the other Ct values were removed prior to analysis, except for samples IP'ed with unspecific rabbit IgG antibody (where all were included). The fraction of input DNA bound by specific antibodies was calculated for each ChIP experiment: (average DNA quantity in IP'ed sample)/(average DNA quantity in input sample)*100%. The fraction of input DNA immunoprecipitated by unspecific rabbit IgG antibody was ≤0.16%.

Statistical Analysis

Unless otherwise stated, all statistical analyses were conducted in Stata version 10.1. Analysis of 27K Infinium data: Cluster analysis including CpG sites with a variance >0.03 was performed in the Illumina software GenomeStudio® using the correlation algorithm. Statistical significance of differential methylation between ADJ-N and PC samples was tested with a Mann-Whitney U test using R (http://www.r-project.org/). Δβ=|mean β PC samples−mean β ADJ-N samples|. Xβ=mean β PC samples/mean β ADJ-N samples. Prior to calculation of significance, Δβ and Xβ the largest and smallest β-value from each of the groups were removed as previously described (Oster, B., et al., Identification and validation of highly frequent CpG island hypermethylation in colorectal adenomas and carcinomas. Int J Cancer, 2011).

Receiver operated characteristics (ROC) analysis was performed on ADJ-N and BPH versus RP samples. Survival analysis was conducted using PSA recurrence as endpoint. In cohort 1, RP samples were divided into high and low methylation groups for each marker based on ROC analysis of recurrence/no recurrence data within 48 months of surgery; Individual markers, as well as all available clinicopathological parameters (pre-operative PSA, Gleason sum, T-stage and free resection margins), were analyzed by uni- or multivariate cox regression analysis. Combinations of markers (as described in text) were tested by uni- or multivariate cox regression analysis. For all analyses, hazard ratios (HRs) were reported with 95% confidence intervals and P-values. To evaluate the prognostic strength of candidate methylation biomarkers when combined with clinicopathological variables, we calculated a weighted sum of variables included in multivariate models. Each variable was weighed by the estimated regression coefficients in the proportional-hazards model. Areas under the curves (AUCs) for single variables and weighted sums were calculated using recurrence/non-recurrence status at 36 months follow-up. For Kaplan-Meier plots P-values of log rank tests were reported. Where appropriate, correction for multiple testing was conducted according to Hochberg (Hochberg, Y. A sharper bonferroni procedure for multiple tests of significance. Biometrika, 1988. 75: p. 800).

Example 1: Identification of Biomarkers for Prostate Cancer

Infinium Screening of Single CpG Site Methylation Levels

Using Illumina's Infinium 27K Methylation Assay, 27,578 CpG sites were assayed for methylation in DNA from nine adjacent normal (ADJ-N), five clinically localized PCs (RPs) and four primary PC samples from patients with metastases (MPCs). In addition, the three prostatic cell lines BPH-1, LNCaP and DU145 were analyzed. Each CpG site was assigned a β-value ranging from 0 (un-methylated) to 1 (fully methylated). Unsupervised clustering analysis, based on the most variably methylated CpG sites across patient samples (variance>0.03, 932 CpG sites) clearly separated non-malignant and PC samples (FIG. 1A). Thus, all ADJ-N samples clustered together. Two RP samples resembled the ADJ-N samples, whereas the remaining RP and MPC samples formed a separate cluster. The intermixture of RP and MPC samples suggested that the overall cancer-specific methylation pattern is established early in cancer development.

Figure 3:
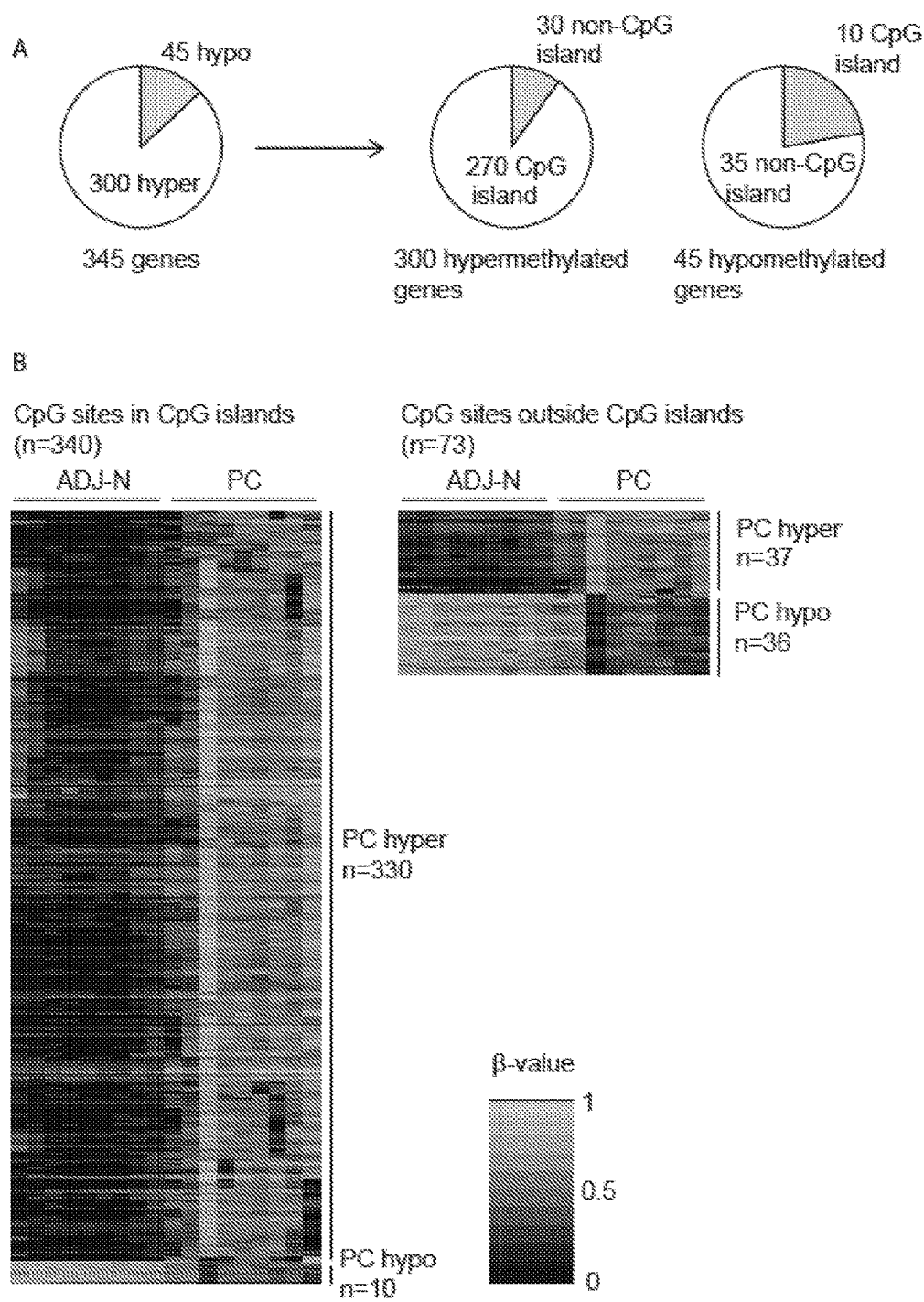
FIG. 3. Diagram of CpG sites differentially methylated between non-malignant and cancer samples and heatmaps showing all differentially methylated CpG sites between PC and non-malignant samples. A All genes differentially methylated in PC versus ADJ-N samples, divided into hyper- and hypo-methylated genes as well as CpG island associated/non-CpG island associated based on the annotations provided by Illumina. B Heatmaps displaying significantly differentially methylated CpG sites between non-malignant and PC samples (P<0.01, Mann-Whitney U test and Δβ>0.3). CpG sites divided into groups by localization relative to CpG islands based on the annotation provided by Illumina.

A total of 3,666 CpG sites covering 2,991 genes were significantly differentially methylated between PC and ADJ-N samples (P<0.01, Mann-Whitney U test). Of these, 413 CpG sites covering 345 genes displayed a Δβ of more than 0.3 (Table 2). The majority of the 345 genes were hypermethylated in PC (300/345, 87%) with most of the CpG sites located within CpG islands (270/300, 90%), CpG sites of hypomethylated genes were predominantly located outside CpG islands (FIG. 3).

Selection of Candidate Genes

We identified six cancer specific hypermethylated genes as novel DNA methylation markers for PC, namely AOX1, C1orf114, GAS6, HAPLN3, ST6GALNAC3 and ZNF660 (Table 2, FIG. 1B). Candidate gene selection was based on i) difference in methylation levels between ADJ-N and PC sample groups (Δβ), ii) fold change in methylation levels between ADJ-N and PC sample groups (Xβ), and, when possible, iii) presence of >1 CpG site indicating cancer associated hypermethylation. We preferably included genes not previously investigated in relation to PC.

Example 2: Validation of the Identified Biomarkers

Figure 4:
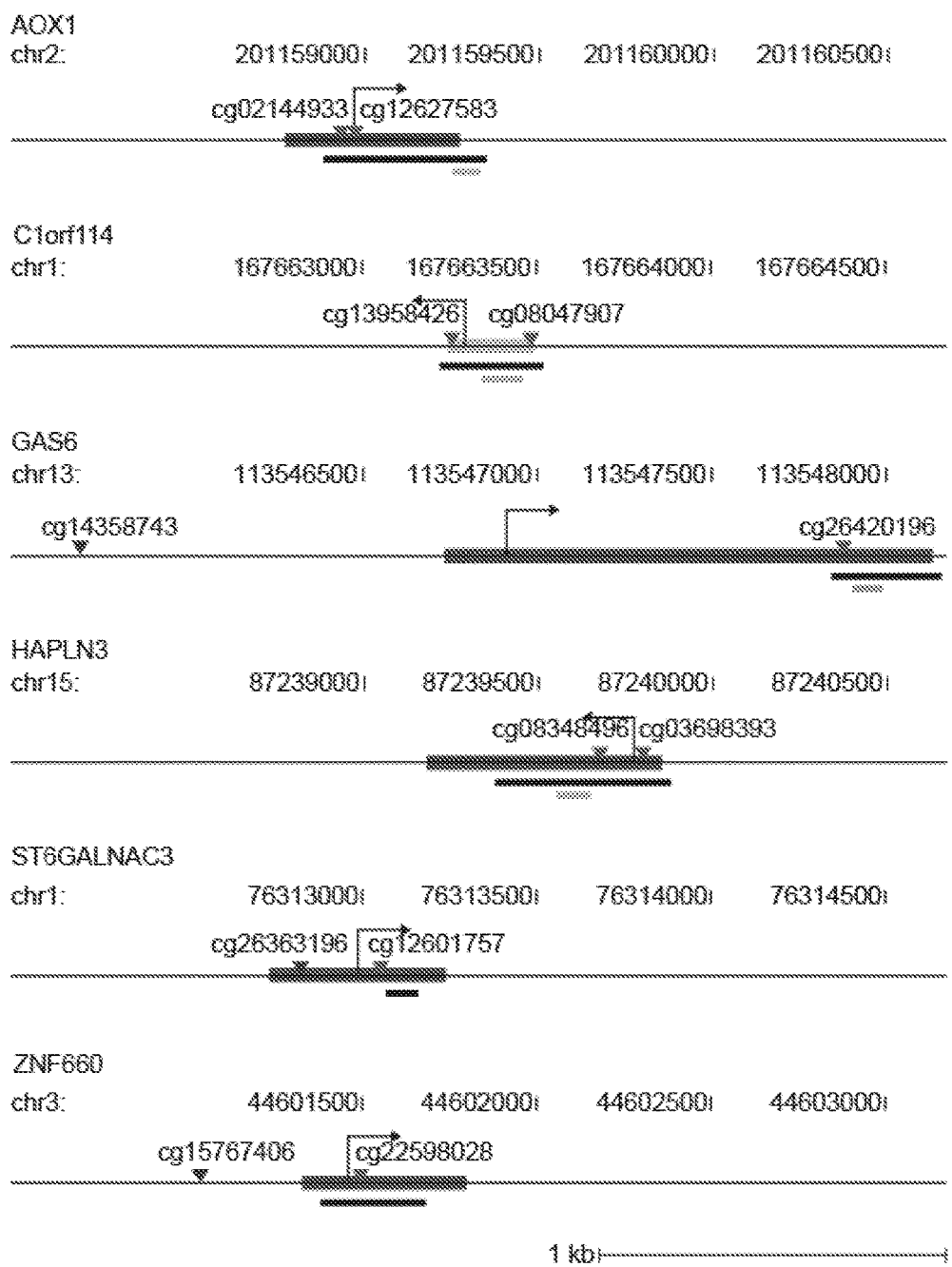
FIG. 4. Schematic drawing of promoter structure and localization of bisulfite sequencing and quantitative methylation specific assays. Chromosomal coordinates, positions of CpG islands (green bars) and transcription start sites (bent arrows) downloaded from the UCSC genome browser, Genome build 36/hg18. Red triangles: Illumina CpG sites differentially methylated in PC samples compared to ADJ-N samples, blue triangles: Illumina CpG sites not differentially methylated. Black bars: localization of bisulfite sequencing assays. Grey bars: localization of quantitative methylation specific PCRs.
Figure 5:
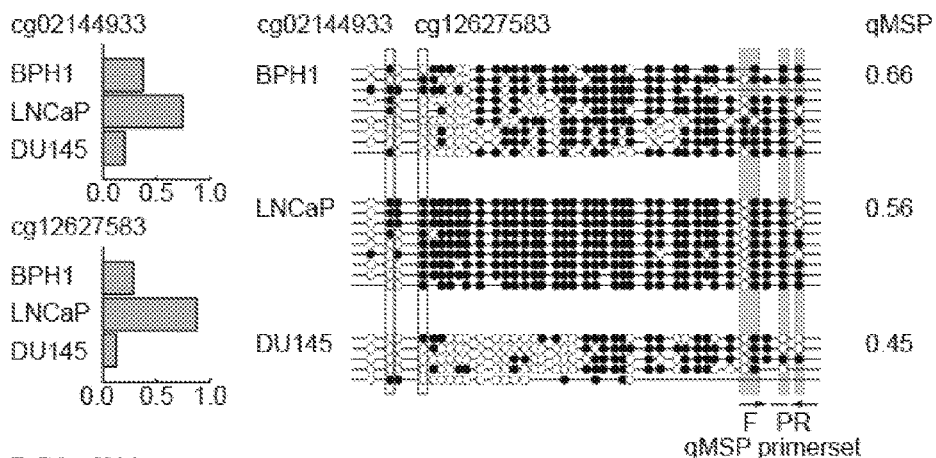
FIG. 5. Illumina β-values for CpG sites, bisulfite sequencing and qMSP data for three cell lines. Left: grey bars represent Illumina β-values in the cell lines for CpG sites associated with the candidate genes, middle: bisulfite sequencing of part of the corresponding CpG island. Each line represents one clone. Open circles: un-methylated CpG sites, black circles: methylated CpG sites, no circle: the base (C/T) could not be determined unambiguously. Red boxes: location of the Illumina CpG sites. Green boxes (A-D): CpG sites encompassed in the qMSP primer-/probesets depicted as arrows and bars below (F: forward primer, P: probe, R: reverse primer). Primers and probes are not drawn to scale. Left (A-D): qMSP results for cell lines calibrated to a standard curve of fully methylated DNA and normalized to MYOD1.
Figure 5:
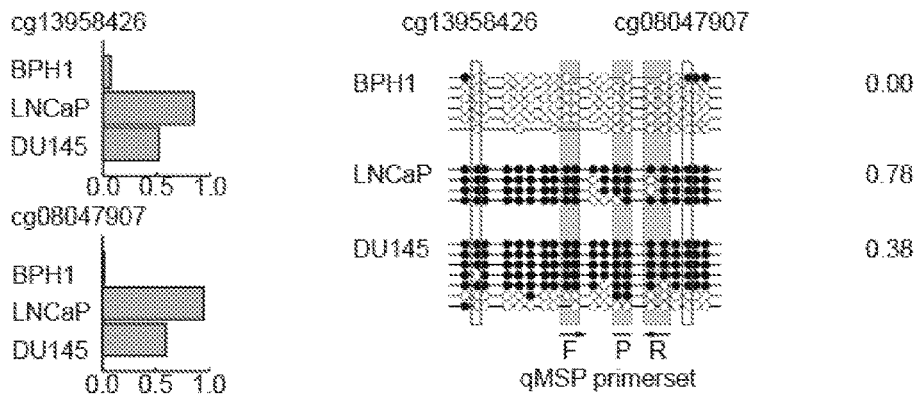
Figure 5:
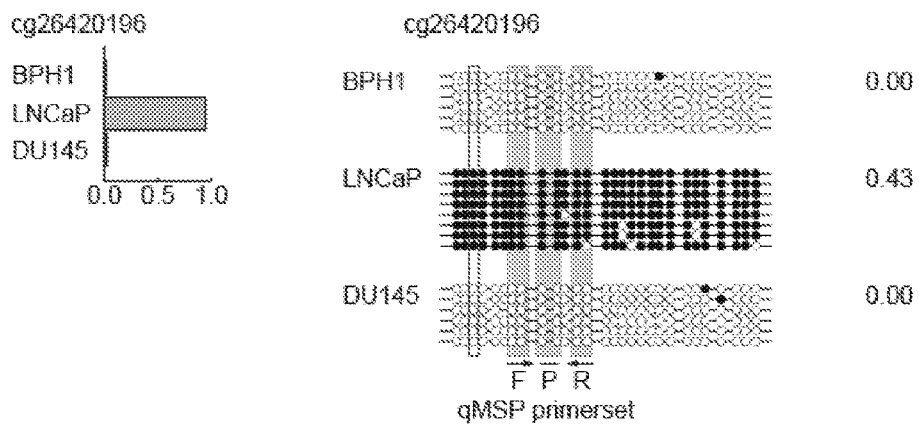

The accuracy of the β-values for the six candidate genes was confirmed by bisulfite sequencing (BS) of DNA from the three cell lines included in the Infinium analysis (FIG. 4 and FIG. 5). The observed cancer-specific hypermethylation in patient samples was further validated in 31 independent non-malignant and PC samples by BS (FIG. 18, FIGS. 13A-13C, and FIG. 6). For all six genes, methylation frequencies were significantly higher in PC samples than in non-malignant samples, confirming Infinium analysis results. ADJ-N and BPH samples did not differ significantly, nor did RP and MPC samples (FIG. 1B).

Figure 6:
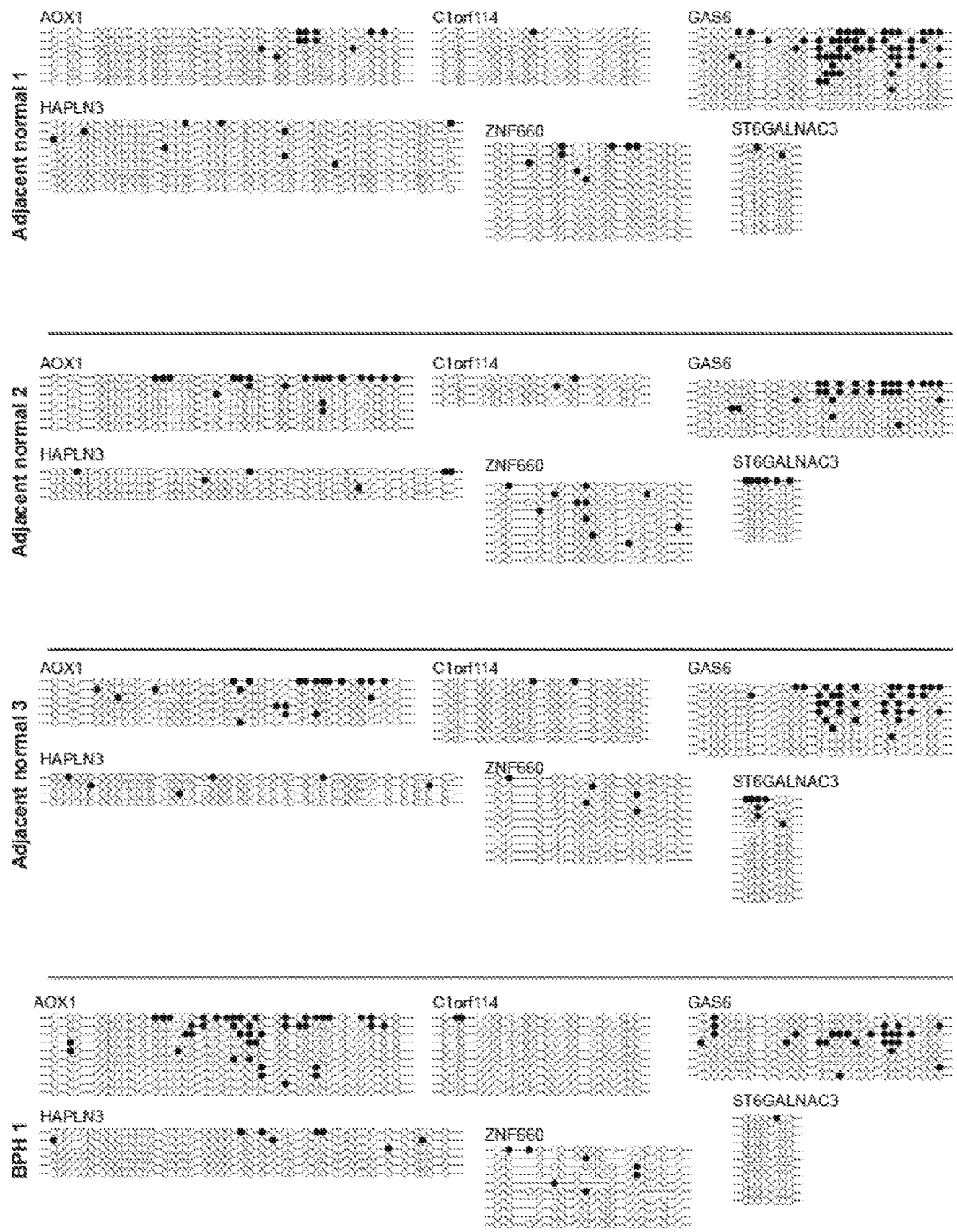
FIG. 6. Examples of bisulfite sequencing of patient samples. Representative bisulfite sequencing results for AOX1, C1orf114, GAS6, HAPLN3, ST6GALNAC3 and ZNF660 in three ADJ-Ns (adjacent normal derived from radical prostatectomy samples), three BPHs (benign prostatic hyperplasia derived from transurethral resections of the prostate), three RPs (clinically localized prostate cancer derived from radical prostatectomy specimens) and three MPCs (metastatic prostate cancer (primary tumour)). Each line represents one clone. Open circles: un-methylated CpG sites, black circles: methylated CpG sites, no circle: the base was not determined unambiguously.

PC samples often contained individual heavily methylated sequences in which most CpG sites were methylated, whereas the non-malignant samples rarely contained sequences with stretches of methylated CpG sites (FIG. 1B and FIG. 6). ST6GALNAC3 and ZNF660 contained highly methylated sequences in non-malignant samples (FIG. 1B).

Four candidates: AOX1, C1orf114, GAS6 and HAPLN3 were further investigated. For large-scale evaluation of methylation levels, we designed qMSP assays targeting methylated alleles of each gene (FIG. 4 and FIG. 5). qMSP assays clearly discriminated fully methylated DNA from heterogeneously methylated and un-methylated DNA in the cell lines BPH-1, LNCaP and DU145 (FIG. 5).

Example 3: Diagnostic Potential of the Biomarkers

Epigenetic Characterization of Candidate Genes

In publicly available clinical gene expression datasets (Oncomine.org) AOX1 and GAS6 were down-regulated in PC in multiple studies and C1orf114 in one study (Table 4), suggesting, that these genes may be repressed by cancer-specific DNA hypermethylation in patient samples, whereas HAPLN3 is not.

Gene expression is regulated by interplay of histone modifications and DNA methylation. To investigate the regulation of the candidate genes in more detail, we analyzed six prostatic cell lines for DNA methylation and RNA expression, as well as for histone H3 lysine 4 trimethylation (H3K4me3) and histone H3 lysine 27 trimethylation (H3K27me3), which are associated with active and silenced gene expression, respectively.

Figure 10:
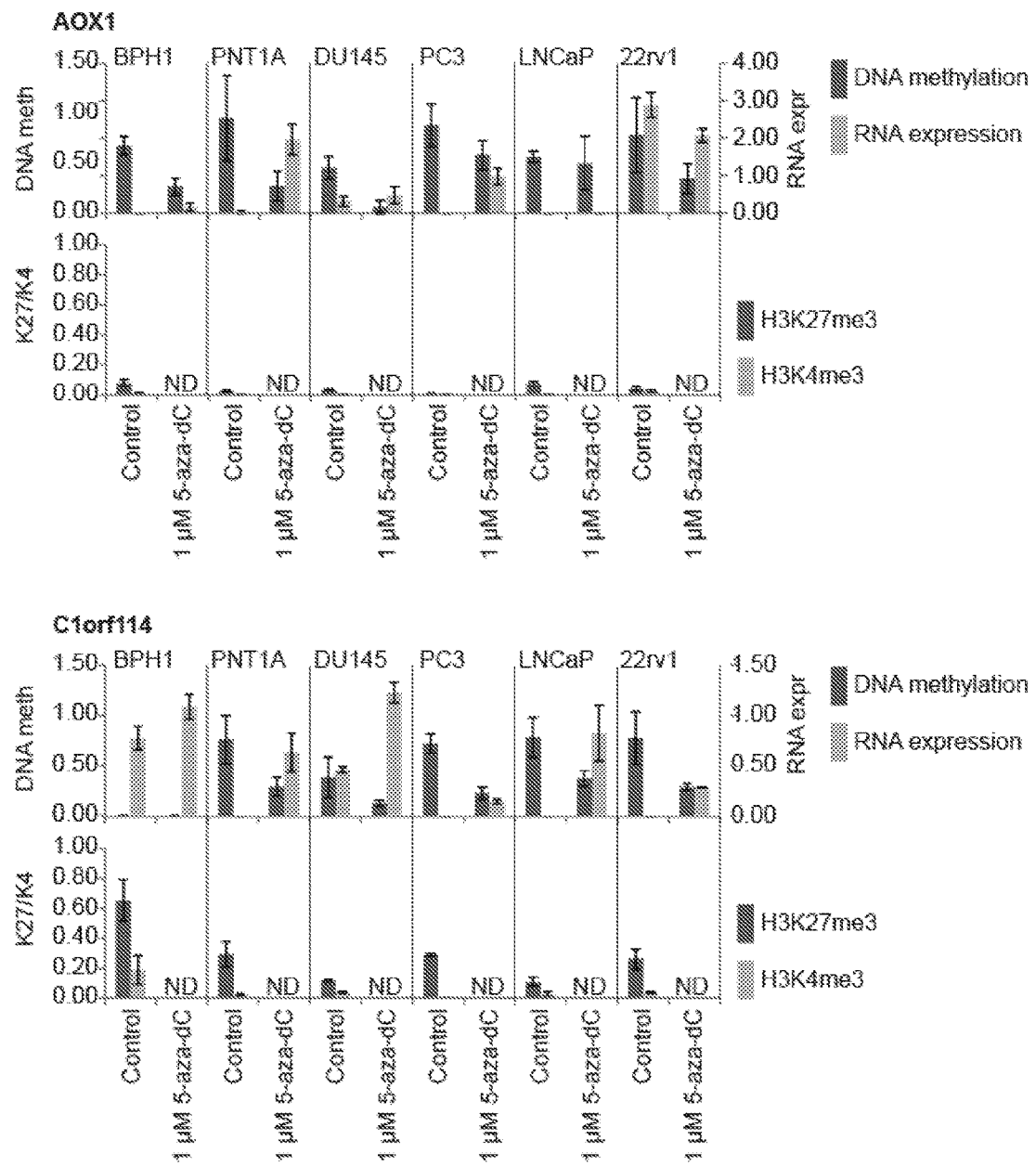
FIG. 10. H3K4me3, H3K27me3, DNA methylation and RNA expression in prostate and prostate cancer cell lines. DNA methylation analysis was performed by qMSP analysis and normalized to MYOD1. RNA expression was normalized to UBC. DNA methylation and RNA expression were both investigated in untreated cells and in cells treated with 5-aza-dC. H3K4me3 is presented as % of input relative to % of input for GAPDH (positive control) in the same cell line. H3K27me3 is presented as % of input relative to % of input for COL2A1 (positive control) in the same cell line. H3K4me3 and H3K27me3 levels were investigated in untreated cells only. Notes for AOX1: The AOX1 gene has several transcription start sites, only expression of the transcript initiated at the hypermethylated CpG island is correlated with DNA methylation, thus upon hypermethylation of the CpG island AOX1 is still transcribed from down-stream transcription start sites (data not shown).

BPH-1 and PNT1A cell lines are both derived from benign tissues, whereas PC3, DU145, LNCaP and 22rv1 cell lines are all derived from PCs. Three out of four candidate genes were expressed in BPH-1, PNT1A or both, and were frequently bivalently marked by H3K4me3/H3K27me3 when expressed (e.g. C1orf114 FIG. 1C and suppl FIG. 5). AOX1 was hypermethylated in all cell lines (FIG. 10). In the PC cell lines, RNA expression and epigenetic marks varied. Each gene was characterized by DNA hypermethylation, gene repression and absence of H3K4me3 in at least one PC cell line (FIG. 10), consistent with an epigenetic silencing mechanism. Furthermore, the H3K27me3 mark often accompanied DNA methylation and gene repression (e.g. C1orf114 FIG. 1C and FIG. 10).

Interestingly, the DNA demethylating drug 5-aza-dC generally stimulated RNA expression from DNA hypermethylated genes when methylation was reduced, but not when DNA methylation levels were unaffected by 5-aza-dC treatment (e.g. C1orf114 FIG. 1C and GAS6 FIG. 10), suggesting that DNA hypermethylation is important for gene repression.

Thus, compiled data suggest that the candidate genes adhere to the established pattern of gene specific DNA hypermethylation of H3K27me3 marked genes in cancer, and that the DNA hypermethylation likely results in reduced expression levels for all candidate genes in cell lines and for four genes in patient samples.

qMSP Based Large Scale Validation of Cancer-Specific Hypermethylation

Figure 7:
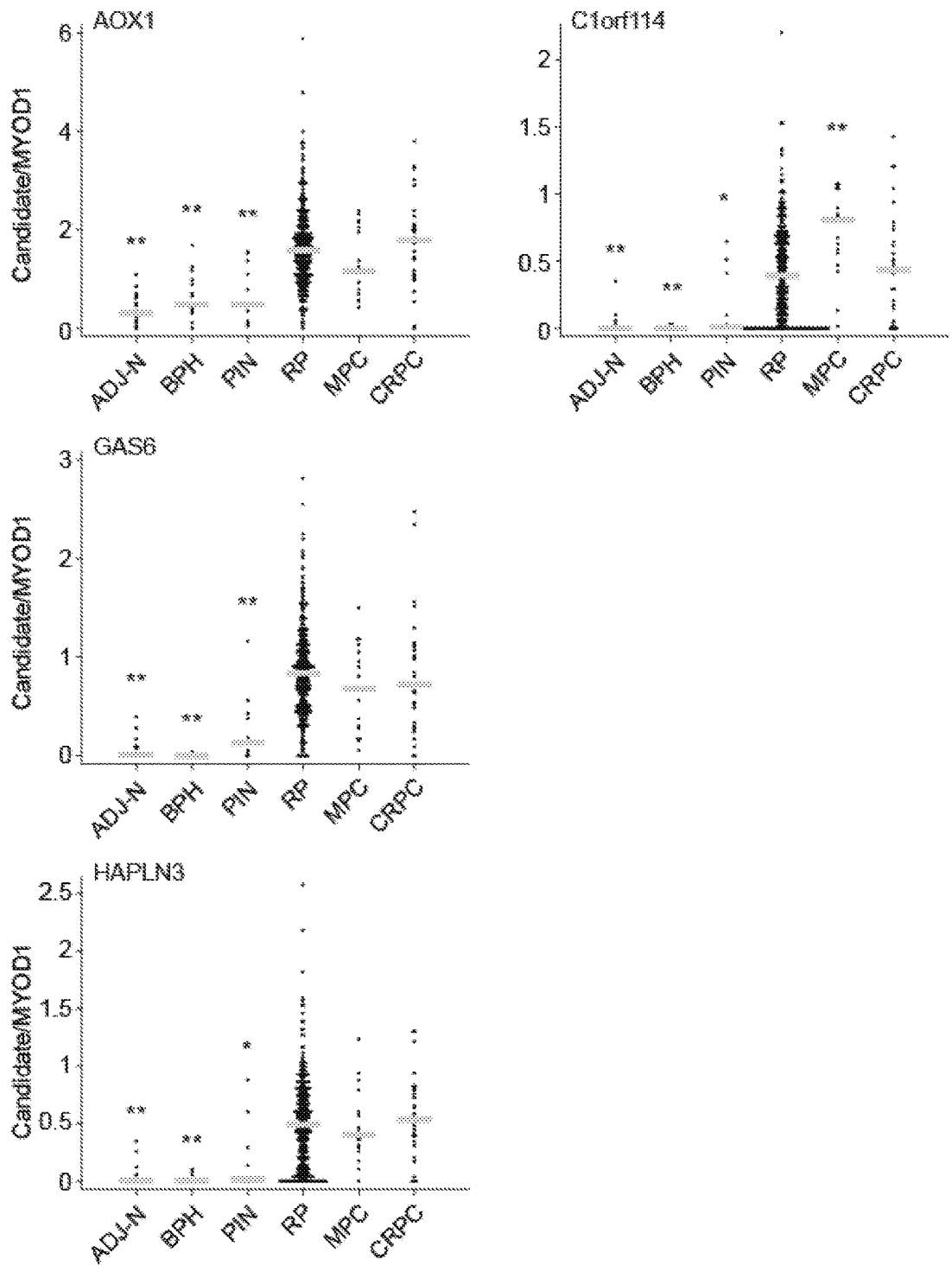
FIG. 7. Methylation levels of individual candidate markers in cohort 1 divided into sample types. DNA was purified from FFPE tissue. Dots: relative quantity of methylated DNA/relative quantity of MYOD1. ADJ-N (n=18): adjacent normal derived from radical prostatectomy samples. BPH (n=15): benign prostatic hyperplasia derived from transurethral resections of the prostate (TURP). PIN (n=11): prostatic intraepithelial neoplasia derived from radical prostatectomy samples. RP (n=319): clinically localized prostate cancer derived from radical prostatectomy specimens, the 319 patients include 26 patients which received endocrine therapy and were therefore not included in any further analyses. CRPC (n=28): castrate refractory prostate cancer from TURP. MPC (n=17): metastatic PC (primary tumour) from TURP. Grey bar: median. * Significantly different from RP (P<0.05). **Significantly different from RP (P<0.001), Mann-Whitney U test.
Figure 8:
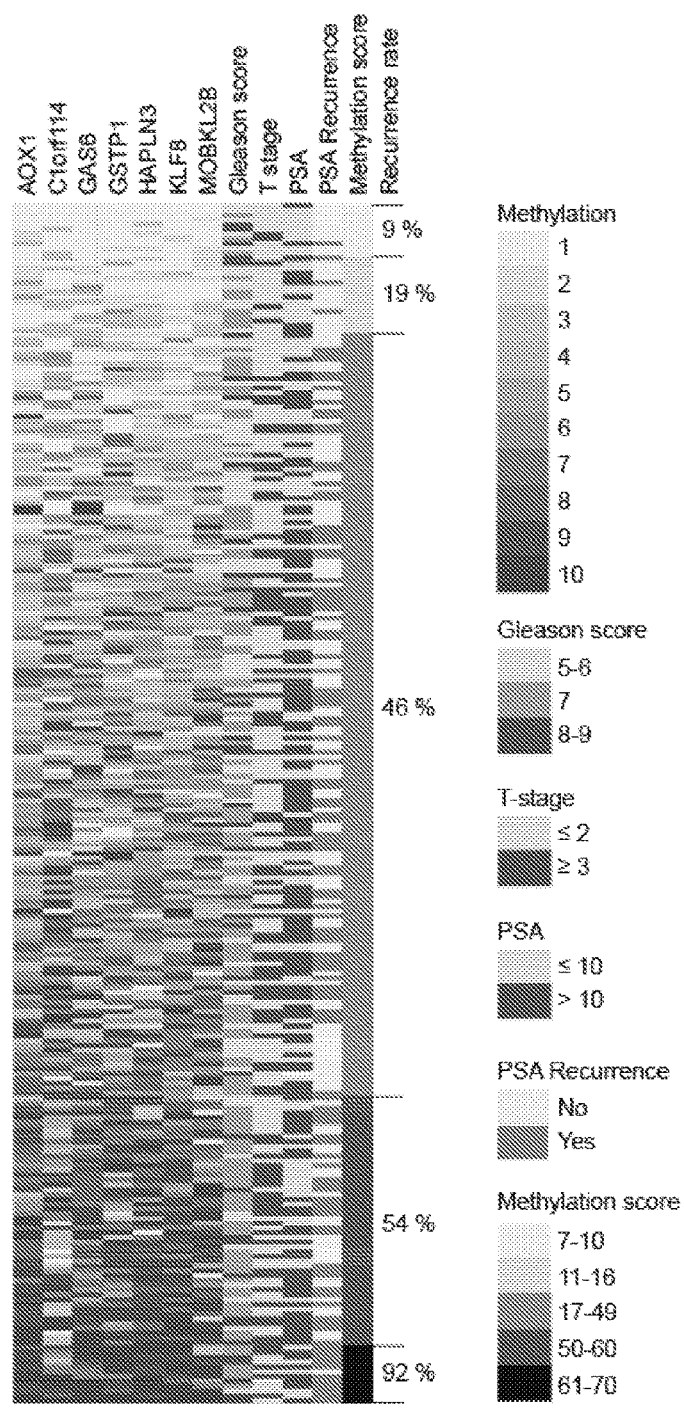
FIG. 8. Heatmap summarizing methylation levels of individual markers. Each marker was divided into 10 equally large groups according to methylation level, each group was sequentially scored (group scores from 1 to 10) and color coded. Only patients with PSA recurrence within 48 months/no recurrence within 48 months after radical prostatectomy were included. Sum: the sum of the group scores for all seven markers, further divided into groups. Recurrence rate: the percentage of patients in each sum group experiencing recurrence after radical prostatectomy.
Figure 9:
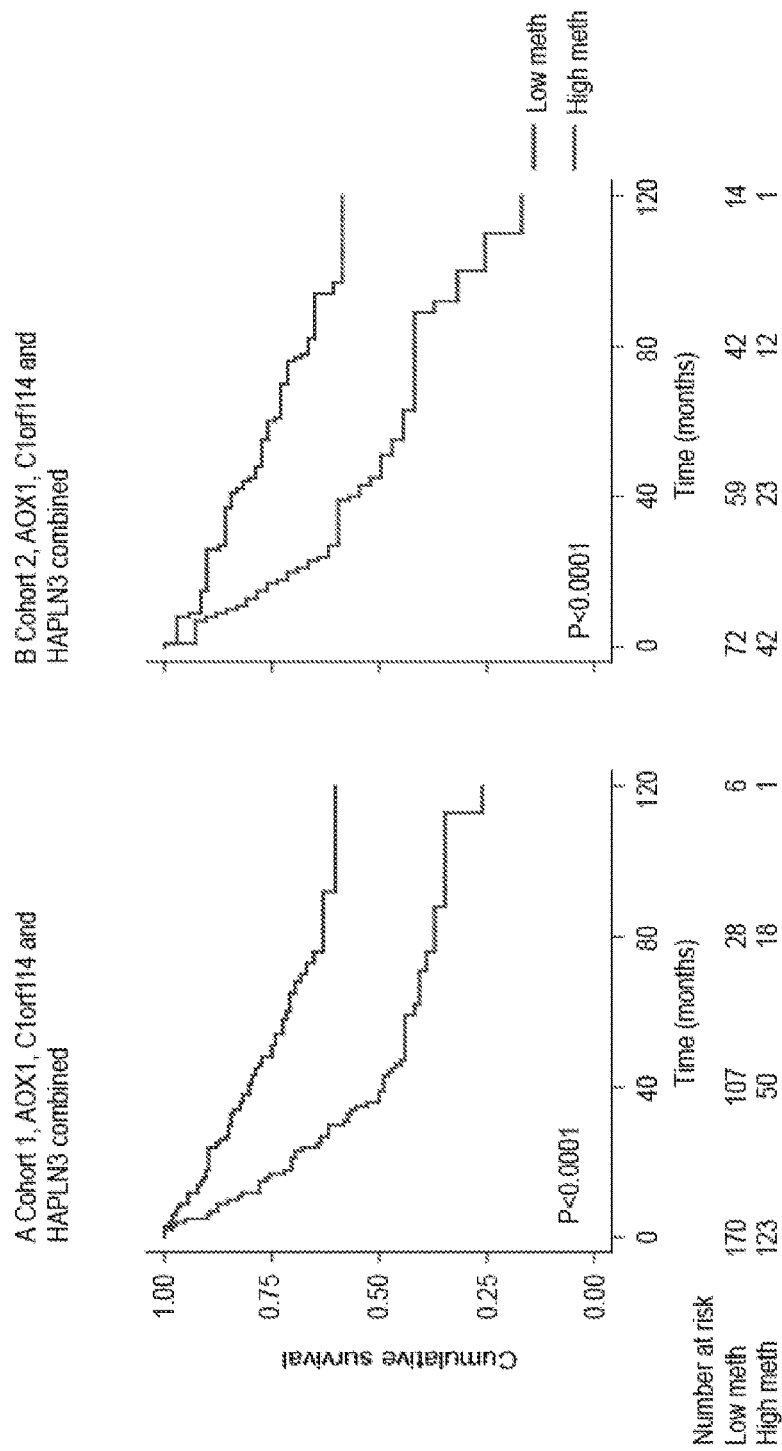
FIG. 9. Kaplan-Meier plots of combinations of markers. A, B: AOX1, C1orf114 and HAPLN3 methylation scores were divided into high and low methylation based on ROC analysis as described in FIG. 12, and a combined score based on all three markers was generated for each patient sample. AOX1/C1orf114/HAPLN3=0: low meth (low risk/low methylation in all three markers), AOX1/C1orf114/HAPLN3=1: high meth (high risk/high methylation in one or more of the three markers). A: Cohort 1. B: Cohort 2.

The methylation levels of the candidate genes were evaluated by qMSP in two independent radical prostatectomy cohorts. First, methylation of the potential markers was tested in cohort 1 consisting of 293 RP samples as well as 18 ADJ-Ns, 15 BPHs, 11 prostatic intraepithelial neoplasias (PINs), 28 castrate refractory PCs (CRPCs) and 17 MPCs. Clinicopathological data for cohort 1 are summarized in table 4 and table 5. The methylation levels of all 4 candidates were significantly lower in ADJ-N, BPH and PIN samples than in the clinically localized cancer (RP) samples (Mann-Whitney U test, P<0.05) (FIG. 7). RP, MPC and CRPC methylation levels were generally highly similar, although C1orf114 methylation levels in MPCs, exceeded the methylation levels in RPs (FIG. 7).

To evaluate the cancer-specificity of the candidate hypermethylation markers, we compared pooled benign samples (ADJ-N and BPH) to RP samples. RP samples were significantly more methylated than benign samples (FIG. 2, Mann-Whitney U test: P<0.0001 for each gene). In ROC analysis, areas under the curves (AUCs) based on benign and RP samples ranged from 0.89 (C1orf114) to 0.98 (GAS6) (FIG. 2A-G). Optimizing specificity to 97% for all markers resulted in sensitivities of 71% (AOX1 and HAPLN3)-93% (GAS6) (Table 3), demonstrating very high cancer-specificity of the markers and indicating promising diagnostic potential.

Example 3: Prognostic Potential of the Biomarkers

We investigated the relationship between methylation, clinicopathological variables and recurrence free survival in the 293 RP samples in cohort 1. For validation we used an independent radical prostatectomy cohort comprised of samples from Germany and Finland including 114 DNA samples purified from fresh-frozen PC samples (cohort 2, Table 4).

Figure 11:
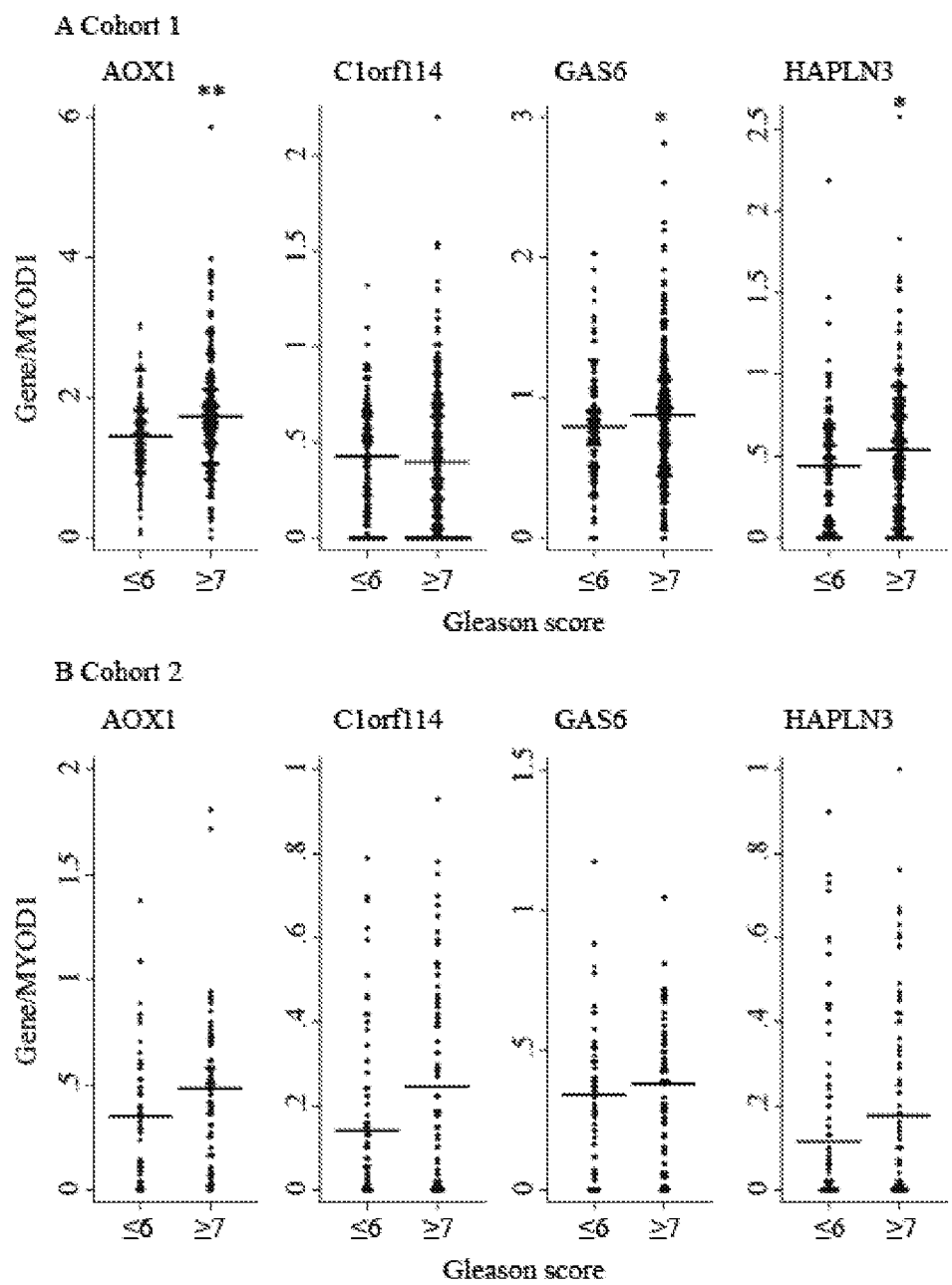
FIG. 11. Methylation levels of individual candidate markers in cohort 1 and 2 divided into groups by clinicopathological parameters. Only RP samples included. Dots: relative quantity of methylated DNA/relative quantity of MYOD1. A Cohort 1 and B Cohort 2 methylation levels divided into two groups: Gleason sum≤6 Gleason sum>6. C Cohort 1 and D Cohort 2 methylation levels divided into two groups: T-stage≤2 and T-stage>2. E Cohort1 and F Cohort 2: Dotplot depicting the association of pre-operative PSA levels (ng/mL) with methylation levels, Spearman's rho and P-value given for each gene. * Groups significantly different (P<0.05). **Groups significantly different (P<0.001), Mann-Whitney U test.
Figure 12:
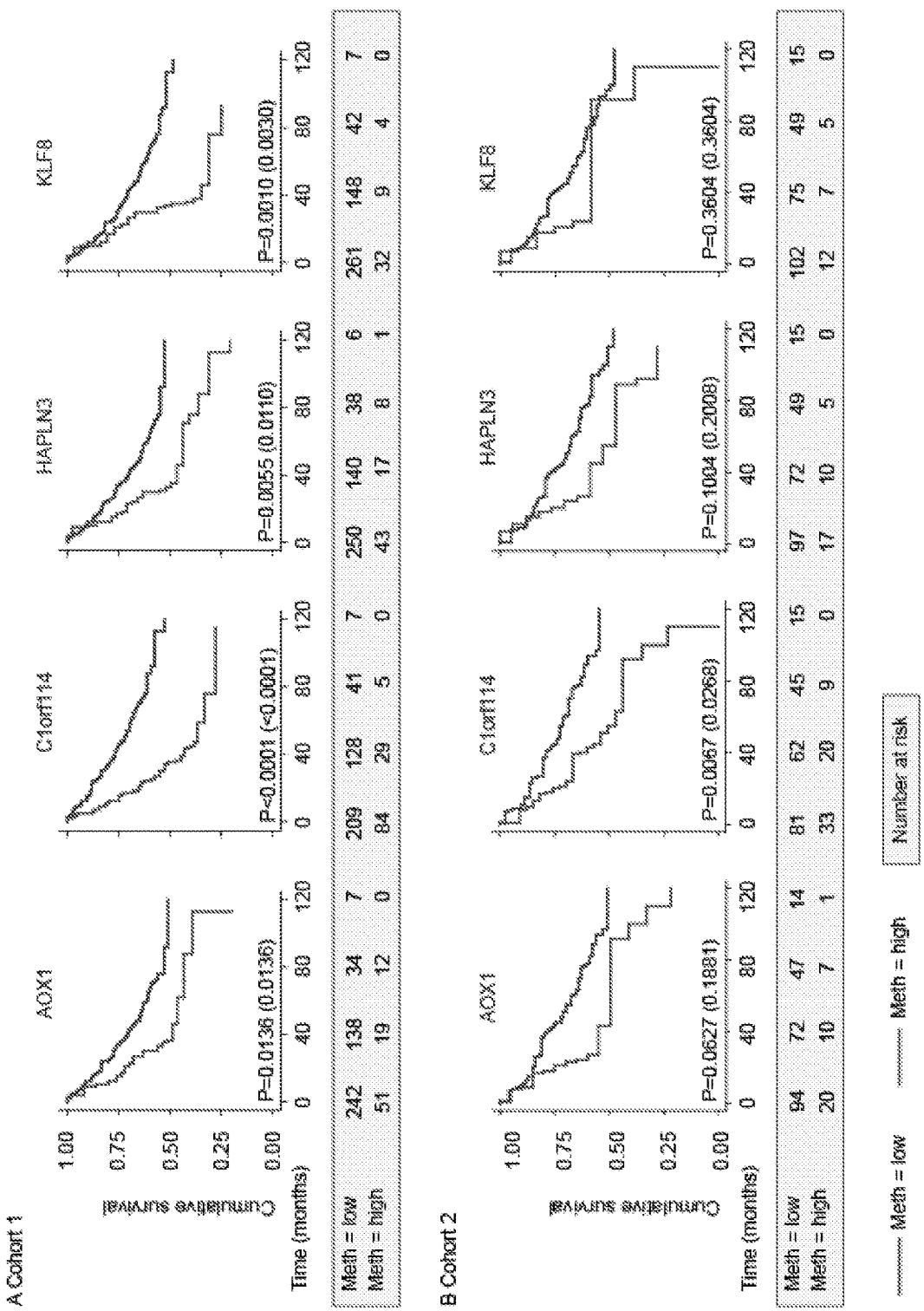
FIG. 12. Kaplan-Meier plots with time to PSA recurrence as endpoint. A: Cohort 1. Samples were divided into a high and low methylation group based on ROC analyses of recurrence/no recurrence within 48 months of radical prostatectomy. B: Cohort 2. Samples were divided into a high and low methylation based on cut-offs (fractions) defined in cohort 1. Log rank test P-value, and log rank test P-value corrected for multiple testing according to Hochberg in parentheses given in each plot.

None of the markers were significantly associated with age, but for several markers, hypermethylation was positively correlated with high Gleason score, high T-stage and/or high pre-operative PSA levels in one or both cohorts (Table 6, FIG. 11).

Survival Analysis. ROC Based Model

Using gene methylation as continuous variables in univariate cox regression analysis of time to PSA recurrence, AOX1, C1orf114, HAPLN3, and KLF8 were significant in cohort 1 (training cohort) (P<0.05); C1orf114 and KLF8 remained significant after adjustment for multiple testing (Table 7). C1orf114 was also significant in multivariate analysis including all clinicopathological parameters (Table 8). The prognostic value of C1orf114 in multivariate analysis was successfully validated in cohort 2 (Table 8). Thus, C1orf114 was a significant independent predictor of PSA recurrence after RP in two cohorts. Of note, the prognostic value of KLF8 in univariate analysis was also validated in cohort 2 (Table 9). AUCs of weighted sums of all clinicopathological variables, excluding lymph node status which was not significant in multivariate analysis, increased from 0.824 to 0.845 in cohort 1, and from 0.863 to 0.875 in cohort 2 by addition of C1orf114, suggesting improved model performance (Table 8). Excluding margin status (not significant in univariate analysis in cohort 2), gave similar results in both cohorts.

When applied clinically, biomarkers are often dichotomized (e.g. PSA and PCA3) facilitating unambiguous interpretation of test results. Using cohort 1 for training, we dichotomized AOX1, C1orf114, HAPLN3, and KLF8 into high/low methylation groups based on ROC analyses of recurrence status. All four dichotomized markers were significant in univariate cox regression analysis and log rank tests, while only C1orf114 remained significant in multivariate analysis (FIG. 3A, Table 10). We used cohort 2 for validation, and dichotomized patients based on the cut-off (fraction) defined in cohort 1. C1orf114 (dichotomized) was significant in univariate as well as multivariate analysis in cohort 2. By single-gene analysis, none of the other three markers were significant as dichotomized variables in cohort 2 (FIG. 3B, Table 11).

PC is an (epi)genetically heterogeneous disease, and combinations of markers are likely to perform better than single markers. We therefore tested whether including additional markers in dichotomized models could improve the prognostic accuracy. We investigated all combinations of dichotomized AOX1, C1orf114, HAPLN3, and KLF8 in cohort 1. Five of eleven multi-gene models were significant (corrected P<0.05) in multivariate cox regression analysis including all clinicopathological parameters (Table 12). The best two-gene (C1orf114/HAPLN3) and the best three-gene (AOX1/C1orf114/HAPLN3) model were successfully validated in cohort 2 as significant predictors of biochemical recurrence in multivariate analysis (Table 8, FIG. 4, Table 13). In cohort 2, C1orf114/HAPLN3 and AOX1/C1orf114/HAPLN3 both performed markedly better than C1orf114 alone, and AOX1/C1orf114/HAPLN3 performed slightly better than C1orf114/HAPLN3, suggesting that incorporation of a few genes into a simple dichotomized methylation-based test can improve robustness compared to a single-marker test. The fraction of patients classified as highly methylated by dichotomized C1orf114 alone (29%) increased to 38% and 42% in cohort 1, and to 34% and 37% in cohort 2, in the C1orf114/HAPLN3 and AOX1/C1orf114/HAPLN3 model, respectively. In multivariate analysis, hazard ratios (HRs) of the AOX1/C1orf114/HAPLN3 model reached 1.91 (1.26-2.90) (cohort 1) and 2.33 (1.31-4.13) (cohort 2) (Table 8). Three years post-surgery, 52% and 41% of patients in the high methylation group had experienced biochemical recurrence, compared to only 19% and 14% of patients in the low methylation group in cohorts 1 and 2, respectively. AUCs of weighted sums of all clinicopathological variables increased from 0.824 to 0.836 in cohort 1, and from 0.863 to 0.869 in cohort 2 by addition of the AOX1/C1orf114/HAPLN3 methylation signature, suggesting moderately improved model performance. Excluding margin status gave similar results in both cohorts (Table 8).

Example 4: Combinations of Markers

Methylation markers may be combined into multi-gene panels for both diagnostic (Table 15) and prognostic use (Table 16). PC is an (epi)genetically heterogeneous disease, and combinations of markers are likely to perform better than single markers (Prensner et al.: Beyond PSA: The next generation of prostate cancer biomarkers. 2012. 4(127): 127rv3). Furthermore, the use of marker panels may alleviate loss of statistical power when markers are dichotomized (see e.g. example 3).

TABLE 1

413 CpG sites differentially methylated between ADJ-N and PC samples with a Δβ of more than 0.3.

| GENE SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| ABCA3 | 21 | cg00949442 | 2331829 | 16 | TRUE | 0.18 | 0.63 | 0.45 | 3.44 |
| ABHD9 | 79852 | cg05488632 | 15204174 | 19 | TRUE | 0.15 | 0.54 | 0.39 | 3.57 |
| ACOT11 | 26027 | cg10266490 | 54786297 | 1 | FALSE | 0.17 | 0.48 | 0.31 | 2.80 |
| ACSM1 | 116285 | cg16940935 | 20609929 | 16 | FALSE | 0.86 | 0.55 | 0.31 | 0.64 |
| ACTA1 | 58 | cg13547644 | 227636231 | 1 | TRUE | 0.12 | 0.50 | 0.38 | 4.20 |
| ADCY4 | 196883 | cg16761581 | 23873647 | 14 | TRUE | 0.09 | 0.56 | 0.47 | 6.39 |
| ADCY4 | 196883 | cg12265829 | 23873862 | 14 | TRUE | 0.12 | 0.58 | 0.46 | 4.86 |
| AKR1B1 | 231 | cg18416881 | 133794363 | 7 | TRUE | 0.02 | 0.52 | 0.50 | 22.52 |
| AKR1B1 | 231 | cg13801416 | 133794459 | 7 | TRUE | 0.03 | 0.61 | 0.59 | 22.10 |
| ALDH1L1 | 10840 | cg16312163 | 127382091 | 3 | TRUE | 0.06 | 0.44 | 0.38 | 7.34 |
| ALDH1L14 | 10840 | cg07800320 | 127382257 | 3 | TRUE | 0.04 | 0.39 | 0.35 | 10.84 |
| ALOX12 | 239 | cg03760483 | 6840021 | 17 | TRUE | 0.24 | 0.58 | 0.35 | 2.45 |
| ALOX15 | 246 | cg09872233 | 4491674 | 17 | TRUE | 0.05 | 0.52 | 0.48 | 11.48 |
| ALOX15 | 246 | cg15843823 | 4491713 | 17 | TRUE | 0.08 | 0.55 | 0.47 | 6.92 |
| ALX4 | 60529 | cg00061629 | 44281834 | 11 | TRUE | 0.30 | 0.72 | 0.42 | 2.40 |
| ALX4 | 60529 | cg19358442 | 44282263 | 11 | TRUE | 0.16 | 0.50 | 0.35 | 3.22 |
| ALX4 | 60529 | cg04549333 | 44282399 | 11 | TRUE | 0.13 | 0.45 | 0.32 | 3.46 |
| ALX4 | 60529 | cg14144305 | 44282536 | 11 | TRUE | 0.14 | 0.45 | 0.31 | 3.22 |
| ALX4 | 60529 | cg08993172 | 44283843 | 11 | TRUE | 0.15 | 0.45 | 0.30 | 3.02 |
| ALX4 | 60529 | cg04970352 | 44283975 | 11 | TRUE | 0.26 | 0.70 | 0.43 | 2.63 |
| ALX4 | 60529 | cg08914623 | 44284148 | 11 | TRUE | 0.19 | 0.50 | 0.30 | 2.58 |
| AMT | 275 | cg20191453 | 49434859 | 3 | TRUE | 0.31 | 0.65 | 0.34 | 2.09 |
| ANGPTL2 | 23452 | cg09427311 | 128925551 | 9 | TRUE | 0.19 | 0.54 | 0.34 | 2.77 |
| AOX1 | 316 | cg02144933 | 201158935 | 2 | TRUE | 0.05 | 0.57 | 0.51 | 11.05 |
| AOX1 | 316 | cg12627583 | 201158976 | 2 | TRUE | 0.06 | 0.55 | 0.49 | 9.86 |
| APC | 324 | cg16970232 | 112101332 | 5 | TRUE | 0.09 | 0.54 | 0.46 | 6.27 |
| APC | 324 | cg20311501 | 112101401 | 5 | TRUE | 0.10 | 0.42 | 0.31 | 4.10 |
| APC | 324 | cg21634602 | 112101469 | 5 | TRUE | 0.04 | 0.45 | 0.41 | 11.78 |
| APC | 324 | cg15020645 | 112101668 | 5 | FALSE | 0.11 | 0.43 | 0.33 | 4.07 |
| APOBEC3C | 27350 | cg07186138 | 37740342 | 22 | FALSE | 0.10 | 0.47 | 0.37 | 4.71 |
| APOBEC3G | 60489 | cg26022401 | 37803334 | 22 | FALSE | 0.12 | 0.45 | 0.33 | 3.79 |
| ARX | 170302 | cg25053900 | 24943811 | X | TRUE | 0.21 | 0.60 | 0.39 | 2.80 |
| ATXN3 | 4287 | cg02028524 | 91643163 | 14 | TRUE | 0.86 | 0.47 | 0.38 | 0.55 |
| B3GALT7 | 374907 | cg20557104 | 46626153 | 19 | FALSE | 0.12 | 0.57 | 0.45 | 4.70 |
| BAIAP3 | 8938 | cg18282543 | 1324683 | 16 | TRUE | 0.11 | 0.46 | 0.36 | 4.34 |
| BCL2 | 596 | cg21602520 | 59136360 | 18 | TRUE | 0.14 | 0.47 | 0.33 | 3.40 |
| BHMT | 635 | cg10660256 | 78443439 | 5 | TRUE | 0.25 | 0.62 | 0.37 | 2.45 |
| BIK | 638 | cg26453588 | 41835965 | 22 | TRUE | 0.28 | 0.59 | 0.31 | 2.13 |
| BNC1 | 646 | cg10398682 | 81743023 | 15 | TRUE | 0.16 | 0.46 | 0.30 | 2.90 |
| BRDG1 | 26228 | cg04398282 | 68106851 | 4 | TRUE | 0.69 | 0.39 | 0.30 | 0.56 |
| BTG4 | 54766 | cg22879515 | 110888725 | 11 | TRUE | 0.24 | 0.62 | 0.38 | 2.60 |
| C10orf82 | 143379 | cg07621046 | 118419648 | 10 | TRUE | 0.27 | 0.62 | 0.35 | 2.26 |
| C12orf34 | 84915 | cg01335367 | 108656591 | 12 | FALSE | 0.30 | 0.62 | 0.32 | 2.09 |
| C1orf114 | 57821 | cg13958426 | 167663261 | 1 | TRUE | 0.06 | 0.47 | 0.41 | 7.99 |
| C1orf114 | 57821 | cg08047907 | 167663482 | 1 | TRUE | 0.08 | 0.51 | 0.43 | 6.65 |
| C1orf158 | 93190 | cg18839416 | 12728436 | 1 | FALSE | 0.66 | 0.35 | 0.31 | 0.53 |
| C1orf87 | 127795 | cg09851465 | 60312259 | 1 | TRUE | 0.23 | 0.59 | 0.36 | 2.59 |
| C1QTNF1 | 114897 | cg24844534 | 74531862 | 17 | TRUE | 0.03 | 0.34 | 0.31 | 11.63 |
| C21orf124 | 85006 | cg23178308 | 43973307 | 21 | TRUE | 0.23 | 0.55 | 0.33 | 2.43 |
| C5orf4 | 10826 | cg10257049 | 154210501 | 5 | FALSE | 0.16 | 0.50 | 0.34 | 3.13 |
| CART | 9607 | cg23300372 | 71051188 | 5 | TRUE | 0.05 | 0.58 | 0.53 | 10.66 |
| CCDC3 | 83643 | cg22750254 | 13083427 | 10 | TRUE | 0.10 | 0.44 | 0.34 | 4.29 |
| CCK | 885 | cg03724463 | 42281528 | 3 | TRUE | 0.15 | 0.48 | 0.33 | 3.27 |
| CD300E | 342510 | cg04995095 | 70131151 | 17 | FALSE | 0.67 | 0.36 | 0.31 | 0.53 |
| CD38 | 952 | cg26043257 | 15389336 | 4 | TRUE | 0.14 | 0.63 | 0.49 | 4.48 |
| CD5L | 922 | cg01637734 | 156077927 | 1 | FALSE | 0.63 | 0.33 | 0.31 | 0.52 |
| CD84 | 8832 | cg16776350 | 158815782 | 1 | FALSE | 0.60 | 0.28 | 0.31 | 0.48 |
| CDH5 | 1003 | cg22319147 | 64958100 | 16 | FALSE | 0.31 | 0.63 | 0.32 | 2.02 |
| CDH8 | 1006 | cg11323198 | 60627307 | 16 | TRUE | 0.10 | 0.44 | 0.33 | 4.24 |
| CDKN2A | 1029 | cg09099744 | 21958372 | 9 | TRUE | 0.13 | 0.55 | 0.42 | 4.39 |
| CDKN2B | 1030 | cg10210238 | 21995995 | 9 | TRUE | 0.30 | 0.63 | 0.34 | 2.13 |
| CDO1 | 1036 | cg12880658 | 115180285 | 5 | TRUE | 0.08 | 0.44 | 0.36 | 5.58 |
| CFHR1 | 3078 | cg12687463 | 195054473 | 1 | FALSE | 0.66 | 0.30 | 0.36 | 0.46 |
| CFHR2 | 3080 | cg09551916 | 195178511 | 1 | FALSE | 0.66 | 0.32 | 0.33 | 0.49 |
| CHAD | 1101 | cg06958829 | 45901117 | 17 | TRUE | 0.35 | 0.67 | 0.32 | 1.93 |
| CHAD | 1101 | cg06818777 | 45901619 | 17 | TRUE | 0.19 | 0.49 | 0.31 | 2.67 |
| CHODL | 140578 | cg24130010 | 18539047 | 21 | TRUE | 0.12 | 0.43 | 0.31 | 3.69 |
| CHX10 | 338917 | cg11525285 | 73776089 | 14 | TRUE | 0.13 | 0.48 | 0.35 | 3.74 |
| CMTM2 | 146225 | cg01683883 | 65170554 | 16 | TRUE | 0.34 | 0.67 | 0.33 | 1.97 |
| CNGA2 | 1260 | cg04613080 | 150653867 | X | FALSE | 0.57 | 0.25 | 0.32 | 0.44 |
| CNGA2 | 1260 | cg17032587 | 150653903 | X | FALSE | 0.70 | 0.29 | 0.41 | 0.41 |
| COL6A1 | 1291 | cg25020459 | 46226572 | 21 | TRUE | 0.04 | 0.43 | 0.38 | 9.78 |
| COL7A1 | 1294 | cg11846236 | 48607572 | 3 | TRUE | 0.06 | 0.48 | 0.42 | 7.94 |
| CPA1 | 1357 | cg15154229 | 129807247 | 7 | FALSE | 0.35 | 0.65 | 0.30 | 1.87 |

TABLE 1-continued

413 CpG sites differentially methylated between ADJ-N and PC samples with a Δβ of more than 0.3.

| SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| CPLX2 | 10814 | cg19885761 | 175156252 | 5 | TRUE | 0.10 | 0.44 | 0.34 | 4.50 |
| CPVL | 54504 | cg24448259 | 29152635 | 7 | TRUE | 0.04 | 0.34 | 0.30 | 8.96 |
| CTTNBP2 | 83992 | cg27603796 | 117300039 | 7 | TRUE | 0.06 | 0.43 | 0.37 | 7.63 |
| CXCL14 | 9547 | cg18995088 | 134942633 | 5 | TRUE | 0.03 | 0.42 | 0.39 | 15.57 |
| CYBA | 1535 | cg26537639 | 87244875 | 16 | TRUE | 0.13 | 0.61 | 0.49 | 4.78 |
| CYBA | 1535 | cg19790294 | 87245256 | 16 | FALSE | 0.09 | 0.46 | 0.37 | 5.04 |
| CYP24A1 | 1591 | cg18956481 | 52223546 | 20 | TRUE | 0.07 | 0.47 | 0.40 | 6.60 |
| CYP27A1 | 1593 | cg03460682 | 219354560 | 2 | TRUE | 0.05 | 0.37 | 0.33 | 7.82 |
| CYP2W1 | 54905 | cg15914863 | 989201 | 7 | FALSE | 0.45 | 0.76 | 0.31 | 1.70 |
| DAB1 | 1600 | cg00848728 | 58488606 | 1 | TRUE | 0.04 | 0.43 | 0.39 | 10.74 |
| DARC | 2532 | cg18552413 | 157441234 | 1 | FALSE | 0.62 | 0.29 | 0.33 | 0.46 |
| DCC | 1630 | cg01839464 | 48122475 | 18 | TRUE | 0.07 | 0.40 | 0.33 | 5.68 |
| DEFB118 | 117285 | cg20312687 | 29420246 | 20 | FALSE | 0.72 | 0.39 | 0.33 | 0.54 |
| DES | 1674 | cg18182399 | 219991419 | 2 | TRUE | 0.15 | 0.46 | 0.31 | 3.12 |
| DGKI | 9162 | cg06277657 | 137182914 | 7 | TRUE | 0.27 | 0.57 | 0.31 | 2.15 |
| DGKZ | 8525 | cg18765542 | 46310677 | 11 | TRUE | 0.17 | 0.56 | 0.39 | 3.33 |
| DKK1 | 22943 | cg07684796 | 53744215 | 10 | TRUE | 0.07 | 0.39 | 0.31 | 5.45 |
| DPYS | 1807 | cg10303487 | 105548234 | 8 | TRUE | 0.10 | 0.53 | 0.43 | 5.52 |
| DUSP15 | 128853 | cg03513363 | 29922406 | 20 | TRUE | 0.14 | 0.47 | 0.32 | 3.23 |
| DYDC1 | 143241 | cg18396533 | 82106188 | 10 | TRUE | 0.16 | 0.53 | 0.37 | 3.35 |
| ECHDC3 | 79746 | cg24428042 | 11824414 | 10 | TRUE | 0.06 | 0.38 | 0.32 | 6.45 |
| EDG2 | 1902 | cg14563260 | 112841141 | 9 | TRUE | 0.07 | 0.52 | 0.45 | 7.65 |
| EDG3 | 1903 | cg11594137 | 90795801 | 9 | TRUE | 0.17 | 0.54 | 0.36 | 3.09 |
| EDG3 | 1903 | cg20083676 | 90795819 | 9 | TRUE | 0.25 | 0.67 | 0.42 | 2.67 |
| EDIL3 | 10085 | cg16773899 | 83716082 | 5 | TRUE | 0.07 | 0.41 | 0.34 | 5.74 |
| EFEMP1 | 2202 | cg20786074 | 56003759 | 2 | TRUE | 0.22 | 0.58 | 0.36 | 2.63 |
| EFS | 10278 | cg07197059 | 22905852 | 14 | TRUE | 0.28 | 0.59 | 0.31 | 2.13 |
| EGFL6 | 25975 | cg00932276 | 13497897 | X | TRUE | 0.05 | 0.55 | 0.50 | 11.11 |
| EIF1B | 10289 | cg04848452 | 40325805 | 3 | TRUE | 0.10 | 0.41 | 0.31 | 4.27 |
| EIF5A2 | 56648 | cg10541755 | 172108566 | 3 | TRUE | 0.07 | 0.40 | 0.33 | 5.59 |
| ELF4 | 2000 | cg06428055 | 129071553 | X | TRUE | 0.09 | 0.56 | 0.47 | 6.16 |
| EOMES | 8320 | cg15540820 | 27740287 | 3 | TRUE | 0.15 | 0.46 | 0.31 | 3.15 |
| EPB41L3 | 23136 | cg00027083 | 5533801 | 18 | TRUE | 0.15 | 0.61 | 0.47 | 4.21 |
| EPHA2 | 1969 | cg15146752 | 16355354 | 1 | TRUE | 0.25 | 0.58 | 0.33 | 2.34 |
| EPO | 2056 | cg08575537 | 100156562 | 7 | TRUE | 0.14 | 0.51 | 0.37 | 3.57 |
| EPSTI1 | 94240 | cg14539231 | 42464262 | 13 | TRUE | 0.05 | 0.50 | 0.45 | 9.97 |
| ESX1 | 80712 | cg04721883 | 103386233 | X | TRUE | 0.07 | 0.41 | 0.34 | 5.94 |
| EYA4 | 2070 | cg20330472 | 133603625 | 6 | TRUE | 0.11 | 0.41 | 0.30 | 3.86 |
| EYA4 | 2070 | cg20286200 | 133603960 | 6 | TRUE | 0.09 | 0.46 | 0.37 | 5.30 |
| EYA4 | 2070 | cg26656135 | 133604467 | 6 | TRUE | 0.04 | 0.36 | 0.33 | 9.77 |
| EYA4 | 2070 | cg24176563 | 133604469 | 6 | TRUE | 0.07 | 0.45 | 0.39 | 6.71 |
| EYA4 | 2070 | cg01805282 | 133605457 | 6 | TRUE | 0.06 | 0.54 | 0.48 | 8.67 |
| F2RL3 | 9002 | cg19006008 | 16860768 | 19 | FALSE | 0.20 | 0.52 | 0.32 | 2.60 |
| FAIM2 | 23017 | cg27188703 | 48583848 | 12 | TRUE | 0.24 | 0.63 | 0.39 | 2.65 |
| FBN2 | 2201 | cg27223047 | 127902724 | 5 | TRUE | 0.13 | 0.56 | 0.43 | 4.44 |
| FBXO39 | 162517 | cg02613386 | 6620257 | 17 | TRUE | 0.12 | 0.43 | 0.31 | 3.58 |
| FBXO39 | 162517 | cg20723355 | 6620321 | 17 | TRUE | 0.07 | 0.43 | 0.37 | 6.45 |
| FCER1A | 2205 | cg14696870 | 157525501 | 1 | FALSE | 0.67 | 0.34 | 0.34 | 0.50 |
| FCGR3A | 2214 | cg04384208 | 159786020 | 1 | FALSE | 0.67 | 0.36 | 0.31 | 0.53 |
| FCGRT | 2217 | cg15528736 | 54707592 | 19 | TRUE | 0.27 | 0.57 | 0.30 | 2.12 |
| FCRL3 | 115352 | cg25259754 | 155936844 | 1 | FALSE | 0.52 | 0.21 | 0.31 | 0.41 |
| FERD3L | 222894 | cg25691167 | 19151486 | 7 | TRUE | 0.10 | 0.47 | 0.37 | 4.75 |
| FLJ00060 | 90011 | cg03602500 | 59739533 | 19 | TRUE | 0.86 | 0.52 | 0.34 | 0.60 |
| FLJ12056 | 79998 | cg18006568 | 71059399 | 2 | TRUE | 0.23 | 0.63 | 0.40 | 2.74 |
| FLJ14503 | 256714 | cg10009830 | 20044825 | X | TRUE | 0.11 | 0.57 | 0.47 | 5.29 |
| FLJ20032 | 54790 | cg08924430 | 106286501 | 4 | TRUE | 0.14 | 0.48 | 0.35 | 3.58 |
| FLJ20920 | 80221 | cg14672994 | 45858056 | 17 | TRUE | 0.10 | 0.48 | 0.38 | 4.60 |
| FLJ21963 | 79611 | cg01283289 | 79996308 | 12 | TRUE | 0.08 | 0.41 | 0.32 | 4.84 |
| FLJ22555 | 79568 | cg13038560 | 200527358 | 2 | TRUE | 0.76 | 0.46 | 0.30 | 0.60 |
| FLJ34922 | 91607 | cg18108623 | 30725434 | 17 | TRUE | 0.08 | 0.41 | 0.32 | 4.96 |
| FLJ44674 | 400535 | cg13897627 | 47935998 | 16 | FALSE | 0.80 | 0.47 | 0.33 | 0.59 |
| FLJ46831 | 399823 | cg13929328 | 129425888 | 10 | TRUE | 0.14 | 0.54 | 0.40 | 3.83 |
| FLJ46831 | 399823 | cg19884262 | 129425958 | 10 | TRUE | 0.05 | 0.46 | 0.41 | 9.20 |
| FLJ90166 | 164284 | cg23418591 | 56523723 | 20 | TRUE | 0.08 | 0.39 | 0.31 | 5.12 |
| FLJ90650 | 206338 | cg15489294 | 115325752 | 5 | TRUE | 0.20 | 0.52 | 0.32 | 2.60 |
| FLJ90650 | 206338 | cg25044651 | 115326619 | 5 | TRUE | 0.17 | 0.58 | 0.41 | 3.44 |
| FLRT2 | 23768 | cg17410236 | 85066248 | 14 | TRUE | 0.06 | 0.55 | 0.49 | 8.52 |
| FLT4 | 2324 | cg00489401 | 180008481 | 5 | TRUE | 0.18 | 0.68 | 0.50 | 3.83 |
| GABRE | 2564 | cg12204574 | 150893428 | X | TRUE | 0.06 | 0.39 | 0.33 | 6.78 |
| GAL3ST3 | 89792 | cg21238818 | 65573218 | 11 | TRUE | 0.10 | 0.41 | 0.31 | 3.98 |
| GALR1 | 2587 | cg04534765 | 73091357 | 18 | TRUE | 0.06 | 0.47 | 0.41 | 7.46 |
| GAS6 | 2621 | cg26420196 | 113547877 | 13 | TRUE | 0.08 | 0.62 | 0.55 | 8.23 |
| GATA4 | 2626 | cg14900471 | 11599029 | 8 | TRUE | 0.05 | 0.36 | 0.31 | 7.07 |
| GBGT1 | 26301 | cg01169778 | 135028511 | 9 | TRUE | 0.44 | 0.75 | 0.30 | 1.68 |

TABLE 1-continued

413 CpG sites differentially methylated between ADJ-N and PC samples with a Δβ of more than 0.3.

| SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| GCM2 | 9247 | cg09829319 | 10990224 | 6 | TRUE | 0.08 | 0.45 | 0.37 | 5.48 |
| GDAP1L1 | 78997 | cg04448487 | 42309191 | 20 | TRUE | 0.15 | 0.60 | 0.45 | 3.98 |
| GDF7 | 151449 | cg05899618 | 20729328 | 2 | TRUE | 0.13 | 0.44 | 0.30 | 3.28 |
| GFI1 | 2672 | cg22341104 | 92724849 | 1 | TRUE | 0.09 | 0.46 | 0.38 | 5.28 |
| GIPC2 | 54810 | cg24496666 | 78284567 | 1 | TRUE | 0.13 | 0.48 | 0.35 | 3.76 |
| GJB5 | 2709 | cg01333788 | 34993401 | 1 | FALSE | 0.30 | 0.62 | 0.33 | 2.11 |
| GLOXD1 | 84842 | cg26781150 | 45565129 | 1 | TRUE | 0.06 | 0.38 | 0.32 | 6.60 |
| GLP1R | 2740 | cg25014318 | 39124754 | 6 | TRUE | 0.11 | 0.45 | 0.34 | 4.00 |
| GNG4 | 2786 | cg09649610 | 233880662 | 1 | TRUE | 0.27 | 0.58 | 0.31 | 2.12 |
| GPR160 | 26996 | cg18741908 | 171239512 | 3 | TRUE | 0.46 | 0.16 | 0.30 | 0.34 |
| GPR75 | 10936 | cg14832904 | 53940532 | 2 | TRUE | 0.40 | 0.74 | 0.33 | 1.83 |
| GPR75 | 10936 | cg19664945 | 53940847 | 2 | TRUE | 0.28 | 0.65 | 0.36 | 2.29 |
| GPRASP2 | 114928 | cg00862041 | 101853673 | X | TRUE | 0.09 | 0.42 | 0.32 | 4.41 |
| GPX2 | 2877 | cg09643186 | 64479205 | 14 | FALSE | 0.47 | 0.78 | 0.31 | 1.66 |
| GPX3 | 2878 | cg21504918 | 150380194 | 5 | TRUE | 0.07 | 0.49 | 0.42 | 6.66 |
| GPX3 | 2878 | cg07699362 | 150380332 | 5 | TRUE | 0.03 | 0.42 | 0.39 | 15.21 |
| GPX3 | 2878 | cg21516478 | 150380521 | 5 | TRUE | 0.10 | 0.55 | 0.45 | 5.55 |
| GPX3 | 2878 | cg17820459 | 150380724 | 5 | TRUE | 0.07 | 0.51 | 0.44 | 7.27 |
| GPX7 | 2882 | cg22129364 | 52840482 | 1 | TRUE | 0.06 | 0.51 | 0.46 | 8.88 |
| GPX7 | 2882 | cg16557944 | 52840785 | 1 | TRUE | 0.04 | 0.62 | 0.58 | 15.58 |
| GRASP | 160622 | cg04034767 | 50687174 | 12 | TRUE | 0.08 | 0.70 | 0.62 | 8.76 |
| GREM1 | 26585 | cg18145505 | 30796790 | 15 | TRUE | 0.19 | 0.49 | 0.30 | 2.58 |
| GRIA3 | 2892 | cg23424962 | 122146020 | X | TRUE | 0.08 | 0.58 | 0.50 | 7.31 |
| GRIA4 | 2893 | cg19343464 | 104986719 | 11 | TRUE | 0.06 | 0.42 | 0.36 | 6.58 |
| GRIK3 | 2899 | cg06722633 | 37271896 | 1 | TRUE | 0.11 | 0.47 | 0.37 | 4.39 |
| GRM4 | 2914 | cg01962826 | 34208945 | 6 | TRUE | 0.90 | 0.57 | 0.33 | 0.63 |
| GSH2 | 170825 | cg21905630 | 54660661 | 4 | TRUE | 0.07 | 0.43 | 0.36 | 5.96 |
| GSTM2 | 2946 | cg03070194 | 110012207 | 1 | FALSE | 0.05 | 0.45 | 0.40 | 8.94 |
| GSTM2 | 2946 | cg16670497 | 110012436 | 1 | TRUE | 0.08 | 0.39 | 0.31 | 4.96 |
| GSTP1 | 2950 | cg02659086 | 67107552 | 11 | TRUE | 0.05 | 0.58 | 0.53 | 12.07 |
| GSTP1 | 2950 | cg04920951 | 67107847 | 11 | TRUE | 0.11 | 0.56 | 0.45 | 4.96 |
| GSTP1 | 2950 | cg09038676 | 67108184 | 11 | TRUE | 0.11 | 0.42 | 0.31 | 3.71 |
| GSTP1 | 2950 | cg11566244 | 67108362 | 11 | TRUE | 0.28 | 0.63 | 0.35 | 2.27 |
| HAPLN3 | 145864 | cg08348496 | 87239675 | 15 | TRUE | 0.03 | 0.50 | 0.47 | 19.75 |
| HCA112 | 55365 | cg26385222 | 150128010 | 7 | TRUE | 0.26 | 0.62 | 0.36 | 2.42 |
| HCA112 | 55365 | cg02244695 | 150128279 | 7 | TRUE | 0.11 | 0.50 | 0.39 | 4.45 |
| HEYL | 26508 | cg25462291 | 39877643 | 1 | TRUE | 0.15 | 0.52 | 0.38 | 3.54 |
| HHIP | 64399 | cg14580567 | 145786721 | 4 | TRUE | 0.07 | 0.46 | 0.39 | 6.84 |
| HIF3A | 64344 | cg02879662 | 51492307 | 19 | TRUE | 0.12 | 0.51 | 0.39 | 4.42 |
| HIST1H1A | 3024 | cg10146929 | 26125918 | 6 | TRUE | 0.14 | 0.49 | 0.34 | 3.37 |
| HIST1H3E | 8353 | cg07922606 | 26333368 | 6 | TRUE | 0.42 | 0.74 | 0.32 | 1.75 |
| HIST1H3G | 8355 | cg02909790 | 26379566 | 6 | TRUE | 0.12 | 0.52 | 0.40 | 4.39 |
| HIST1H3J | 8356 | cg17965019 | 27966524 | 6 | TRUE | 0.16 | 0.57 | 0.41 | 3.60 |
| HIST1H3J | 8356 | cg17718302 | 27966616 | 6 | TRUE | 0.06 | 0.44 | 0.38 | 6.87 |
| HIST1H4D | 8360 | cg21026663 | 26297213 | 6 | TRUE | 0.04 | 0.47 | 0.43 | 11.91 |
| HLA-G | 3135 | cg21529533 | 29903994 | 6 | TRUE | 0.07 | 0.47 | 0.40 | 6.61 |
| HLF | 3131 | cg15835232 | 50698074 | 17 | TRUE | 0.05 | 0.59 | 0.54 | 11.05 |
| HOXA5 | 3202 | cg02248486 | 27149721 | 7 | TRUE | 0.42 | 0.73 | 0.31 | 1.74 |
| HOXB4 | 3214 | cg06760035 | 44010244 | 17 | TRUE | 0.14 | 0.51 | 0.38 | 3.70 |
| HOXB4 | 3214 | cg14458834 | 44010393 | 17 | TRUE | 0.11 | 0.51 | 0.40 | 4.62 |
| HOXB4 | 3214 | cg08089301 | 44010560 | 17 | TRUE | 0.25 | 0.63 | 0.39 | 2.58 |
| HOXC11 | 3227 | cg22709192 | 52653176 | 12 | TRUE | 0.21 | 0.60 | 0.39 | 2.84 |
| HOXD3 | 3232 | cg18702197 | 176735887 | 2 | TRUE | 0.21 | 0.52 | 0.31 | 2.46 |
| HAAO | 23498 | cg20289949 | 42873118 | 2 | TRUE | 0.21 | 0.67 | 0.46 | 3.19 |
| HAAO | 23498 | cg01561916 | 42873673 | 2 | TRUE | 0.04 | 0.64 | 0.59 | 14.81 |
| IGKV7- | 28905 | cg23984130 | 88996300 | 2 | FALSE | 0.76 | 0.46 | 0.30 | 0.60 |
| IMP4 | 92856 | cg09640202 | 130817910 | 2 | TRUE | 0.78 | 0.42 | 0.36 | 0.54 |
| IRXL1 | 283078 | cg02161900 | 28075637 | 10 | TRUE | 0.20 | 0.53 | 0.34 | 2.72 |
| ITGA11 | 22801 | cg14188232 | 66511119 | 15 | TRUE | 0.14 | 0.48 | 0.33 | 3.35 |
| ITGA4 | 3676 | cg20415809 | 182030100 | 2 | TRUE | 0.05 | 0.41 | 0.36 | 8.34 |
| IVL | 3713 | cg05440289 | 151147743 | 1 | FALSE | 0.79 | 0.47 | 0.32 | 0.60 |
| KCNB2 | 9312 | cg20890210 | 73612735 | 8 | TRUE | 0.11 | 0.46 | 0.35 | 4.20 |
| KCNE3 | 10008 | cg23189044 | 73855762 | 11 | TRUE | 0.07 | 0.41 | 0.34 | 5.55 |
| KCNE3 | 10008 | cg02595219 | 73856409 | 11 | TRUE | 0.25 | 0.58 | 0.33 | 2.32 |
| KCNIP2 | 30819 | cg04997967 | 103593478 | 10 | TRUE | 0.29 | 0.62 | 0.33 | 2.12 |
| KCTD8 | 386617 | cg12300353 | 44145115 | 4 | TRUE | 0.05 | 0.42 | 0.38 | 9.01 |
| KLF8 | 11279 | cg06457357 | 56275968 | X | TRUE | 0.12 | 0.56 | 0.44 | 4.80 |
| KLHL1 | 57626 | cg20523861 | 69580325 | 13 | TRUE | 0.21 | 0.58 | 0.37 | 2.79 |
| KLK10 | 5655 | cg08818784 | 56214010 | 19 | TRUE | 0.05 | 0.59 | 0.55 | 12.77 |
| KLK10 | 5655 | cg24512400 | 56214373 | 19 | TRUE | 0.05 | 0.54 | 0.48 | 10.10 |
| KLK10 | 5655 | cg15910208 | 56214400 | 19 | TRUE | 0.05 | 0.50 | 0.45 | 10.01 |
| KLK13 | 26085 | cg26524263 | 56260148 | 19 | TRUE | 0.06 | 0.38 | 0.32 | 6.46 |
| KRT5 | 3852 | cg23645091 | 51200676 | 12 | FALSE | 0.28 | 0.58 | 0.31 | 2.10 |
| KRTAP11-1 | 337880 | cg07014174 | 31175631 | 21 | FALSE | 0.71 | 0.36 | 0.35 | 0.51 |

TABLE 1-continued

413 CpG sites differentially methylated between ADJ-N and PC samples with a Δβ of more than 0.3.

| GENE SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| LAMA2 | 3908 | cg20640433 | 129245899 | 6 | TRUE | 0.12 | 0.51 | 0.39 | 4.39 |
| LAMA2 | 3908 | cg19774122 | 129246315 | 6 | TRUE | 0.07 | 0.39 | 0.33 | 6.00 |
| LEP | 3952 | cg12782180 | 127668168 | 7 | TRUE | 0.33 | 0.68 | 0.35 | 2.05 |
| LEP | 3952 | cg19594666 | 127668516 | 7 | TRUE | 0.30 | 0.71 | 0.40 | 2.32 |
| LGALS1 | 3956 | cg19853760 | 36401623 | 22 | FALSE | 0.24 | 0.55 | 0.31 | 2.30 |
| LOC349136 | 349136 | cg19831077 | 150738857 | 7 | TRUE | 0.27 | 0.64 | 0.37 | 2.37 |
| LOC387758 | 387758 | cg04622802 | 26972448 | 11 | TRUE | 0.17 | 0.56 | 0.39 | 3.27 |
| LOC63928 | 63928 | cg15309006 | 23673617 | 16 | TRUE | 0.06 | 0.45 | 0.39 | 7.74 |
| LPA | 4018 | cg07260592 | 161020112 | 6 | TRUE | 0.16 | 0.58 | 0.41 | 3.57 |
| LR8 | 28959 | cg08359956 | 150129138 | 7 | TRUE | 0.13 | 0.54 | 0.40 | 3.97 |
| LRRC4 | 64101 | cg15087147 | 127459405 | 7 | TRUE | 0.04 | 0.47 | 0.44 | 13.20 |
| LTC4S | 4056 | cg16361890 | 179153151 | 5 | FALSE | 0.22 | 0.54 | 0.32 | 2.48 |
| LTC4S | 4056 | cg11394785 | 179153696 | 5 | FALSE | 0.26 | 0.59 | 0.33 | 2.29 |
| LTF | 4057 | cg15261665 | 46481378 | 3 | TRUE | 0.19 | 0.57 | 0.38 | 2.97 |
| LTF | 4057 | cg17527798 | 46481408 | 3 | TRUE | 0.25 | 0.61 | 0.36 | 2.42 |
| MAGEB6 | 158809 | cg10127415 | 26120444 | X | FALSE | 0.81 | 0.51 | 0.30 | 0.63 |
| MAPK15 | 225689 | cg22892110 | 144870619 | 8 | TRUE | 0.13 | 0.61 | 0.49 | 4.88 |
| MBL2 | 4153 | cg13882988 | 54201351 | 10 | FALSE | 0.77 | 0.46 | 0.31 | 0.60 |
| MCAM | 4162 | cg21096399 | 118693355 | 11 | TRUE | 0.21 | 0.57 | 0.37 | 2.77 |
| MGC39606 | 399668 | cg17231524 | 134384171 | X | TRUE | 0.10 | 0.54 | 0.44 | 5.41 |
| MMP14 | 4323 | cg09208010 | 22375620 | 14 | TRUE | 0.11 | 0.43 | 0.33 | 4.10 |
| MNDA | 4332 | cg25119415 | 157066559 | 1 | FALSE | 0.71 | 0.37 | 0.34 | 0.52 |
| MOBKL2B | 79817 | cg22262168 | 27518999 | 9 | TRUE | 0.07 | 0.63 | 0.55 | 8.89 |
| MRPL30 | 51263 | cg15612847 | 99162750 | 2 | TRUE | 0.79 | 0.46 | 0.33 | 0.58 |
| MSC | 9242 | cg23710218 | 72919210 | 8 | TRUE | 0.23 | 0.55 | 0.32 | 2.39 |
| MYO3A | 53904 | cg08441170 | 26263106 | 10 | TRUE | 0.10 | 0.61 | 0.50 | 5.93 |
| MYO3A | 53904 | cg23771603 | 26263316 | 10 | TRUE | 0.07 | 0.57 | 0.50 | 8.19 |
| MYR8 | 23026 | cg18946226 | 108046504 | 13 | FALSE | 0.25 | 0.56 | 0.31 | 2.28 |
| NALP10 | 338322 | cg18484189 | 7941549 | 11 | FALSE | 0.68 | 0.31 | 0.37 | 0.46 |
| NALP14 | 338323 | cg25203856 | 7016556 | 11 | FALSE | 0.70 | 0.37 | 0.34 | 0.52 |
| NCAM2 | 4685 | cg13297960 | 21292108 | 21 | TRUE | 0.08 | 0.39 | 0.31 | 5.05 |
| NDRG2 | 57447 | cg18081258 | 20564001 | 14 | TRUE | 0.20 | 0.55 | 0.35 | 2.74 |
| NEF3 | 4741 | cg23290344 | 24827371 | 8 | TRUE | 0.13 | 0.53 | 0.40 | 4.07 |
| NEU1 | 4758 | cg14976276 | 31938609 | 6 | TRUE | 0.02 | 0.35 | 0.33 | 14.25 |
| NEUROD1 | 4760 | cg22359606 | 182253737 | 2 | TRUE | 0.10 | 0.43 | 0.32 | 4.10 |
| NFAM1 | 150372 | cg17568996 | 41158069 | 22 | FALSE | 0.15 | 0.51 | 0.37 | 3.54 |
| NFATC4 | 4776 | cg06111454 | 23907676 | 14 | FALSE | 0.08 | 0.41 | 0.33 | 5.22 |
| NID2 | 22795 | cg22881914 | 51605897 | 14 | TRUE | 0.37 | 0.72 | 0.36 | 1.97 |
| NIFIE14 | 10430 | cg00739120 | 40727715 | 19 | TRUE | 0.23 | 0.54 | 0.31 | 2.38 |
| NIP | 90527 | cg15105703 | 43209152 | 15 | TRUE | 0.09 | 0.53 | 0.44 | 5.83 |
| NIPSNAP1 | 8508 | cg13797031 | 28307742 | 22 | FALSE | 0.67 | 0.34 | 0.33 | 0.51 |
| NOX4 | 50507 | cg17063929 | 88864447 | 11 | TRUE | 0.25 | 0.55 | 0.30 | 2.22 |
| NPTX2 | 4885 | cg00548268 | 98083766 | 7 | TRUE | 0.33 | 0.64 | 0.31 | 1.93 |
| NR2E1 | 7101 | cg03958979 | 108593080 | 6 | TRUE | 0.31 | 0.63 | 0.32 | 2.01 |
| NR2E1 | 7101 | cg19697981 | 108594513 | 6 | TRUE | 0.12 | 0.43 | 0.31 | 3.55 |
| NRG1 | 3084 | cg17457560 | 32525393 | 8 | TRUE | 0.05 | 0.37 | 0.32 | 6.95 |
| NUAK1 | 9891 | cg23555120 | 105057993 | 12 | TRUE | 0.30 | 0.63 | 0.33 | 2.12 |
| NXF2 | 56001 | cg00280894 | 101365619 | X | FALSE | 0.69 | 0.38 | 0.31 | 0.55 |
| OR10A5 | 144124 | cg22951794 | 6823856 | 11 | FALSE | 0.76 | 0.39 | 0.37 | 0.51 |
| OR1F1 | 4992 | cg07879977 | 3194568 | 16 | FALSE | 0.67 | 0.36 | 0.31 | 0.53 |
| OR1G1 | 8390 | cg27622610 | 2976935 | 17 | FALSE | 0.71 | 0.39 | 0.32 | 0.55 |
| OR5P3 | 120066 | cg01469547 | 7803731 | 11 | FALSE | 0.87 | 0.49 | 0.38 | 0.56 |
| OTOP1 | 133060 | cg14882700 | 4279472 | 4 | TRUE | 0.16 | 0.47 | 0.31 | 2.91 |
| OXGR1 | 27199 | cg00158308 | 96444342 | 13 | FALSE | 0.07 | 0.45 | 0.39 | 6.85 |
| OXGR1 | 27199 | cg23037133 | 96444812 | 13 | TRUE | 0.08 | 0.39 | 0.31 | 4.93 |
| PAH | 5053 | cg15963417 | 101835430 | 12 | TRUE | 0.05 | 0.39 | 0.34 | 8.00 |
| PAH | 5053 | cg24759821 | 101835592 | 12 | FALSE | 0.09 | 0.46 | 0.37 | 5.18 |
| PALM | 5064 | cg00174901 | 660889 | 19 | FALSE | 0.12 | 0.44 | 0.32 | 3.64 |
| PAQR9 | 344838 | cg00970325 | 144165866 | 3 | TRUE | 0.10 | 0.51 | 0.41 | 5.01 |
| PAX4 | 5078 | cg08886154 | 127043912 | 7 | FALSE | 0.65 | 0.34 | 0.32 | 0.52 |
| PAX7 | 5081 | cg11428724 | 18830219 | 1 | TRUE | 0.10 | 0.44 | 0.33 | 4.28 |
| PCDHB15 | 56121 | cg11368643 | 140605243 | 5 | TRUE | 0.21 | 0.58 | 0.37 | 2.71 |
| PDE4C | 5143 | cg17861230 | 18204901 | 19 | TRUE | 0.18 | 0.49 | 0.31 | 2.69 |
| PDGFRB | 5159 | cg12727795 | 149515888 | 5 | TRUE | 0.12 | 0.55 | 0.43 | 4.65 |
| PENK | 5179 | cg04598121 | 57521059 | 8 | TRUE | 0.17 | 0.54 | 0.36 | 3.13 |
| PGLYRP3 | 114771 | cg09448880 | 151550465 | 1 | FALSE | 0.74 | 0.41 | 0.33 | 0.56 |
| PHOX2A | 401 | cg18722841 | 71632630 | 11 | TRUE | 0.06 | 0.45 | 0.39 | 7.43 |
| PHOX2A | 401 | cg08876932 | 71633195 | 11 | TRUE | 0.08 | 0.47 | 0.39 | 5.89 |
| PIP5KL1 | 138429 | cg10082841 | 129729142 | 9 | TRUE | 0.14 | 0.45 | 0.31 | 3.26 |
| PLEKHA4 | 57664 | cg06339706 | 54063097 | 19 | FALSE | 0.35 | 0.68 | 0.34 | 1.97 |
| PNMA3 | 29944 | cg00800095 | 151974746 | X | TRUE | 0.55 | 0.87 | 0.32 | 1.58 |
| PODN | 127435 | cg23092823 | 53301200 | 1 | TRUE | 0.12 | 0.45 | 0.33 | 3.76 |
| POMC | 5443 | cg16302441 | 25245334 | 2 | TRUE | 0.22 | 0.54 | 0.31 | 2.40 |
| POP2 | 152138 | cg16739580 | 192661768 | 3 | FALSE | 0.69 | 0.39 | 0.30 | 0.56 |

TABLE 1-continued

413 CpG sites differentially methylated between ADJ-N and PC samples with a Δβ of more than 0.3.

| GENE SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| PPT2 | 9374 | cg17329164 | 32229237 | 6 | TRUE | 0.15 | 0.51 | 0.36 | 3.42 |
| PRAP1 | 118471 | cg10742801 | 135011037 | 10 | FALSE | 0.23 | 0.54 | 0.31 | 2.36 |
| PRDM14 | 63978 | cg01295203 | 71146753 | 8 | TRUE | 0.15 | 0.46 | 0.32 | 3.16 |
| PRKAR1B | 5575 | cg13577076 | 718982 | 7 | TRUE | 0.09 | 0.50 | 0.41 | 5.44 |
| PRKCB1 | 5579 | cg05436658 | 23755069 | 16 | TRUE | 0.03 | 0.48 | 0.45 | 16.25 |
| PRR3 | 80742 | cg21264055 | 30631221 | 6 | TRUE | 0.12 | 0.42 | 0.30 | 3.63 |
| PRRT1 | 80863 | cg25426302 | 32228804 | 6 | TRUE | 0.21 | 0.52 | 0.30 | 2.43 |
| PSTPIP1 | 9051 | cg26025891 | 75074954 | 15 | FALSE | 0.19 | 0.55 | 0.36 | 2.87 |
| PTF1A | 256297 | cg11438428 | 23521600 | 10 | TRUE | 0.12 | 0.48 | 0.36 | 4.09 |
| PTPRO | 5800 | cg10646402 | 15366757 | 12 | TRUE | 0.02 | 0.34 | 0.31 | 14.12 |
| PYCARD | 29108 | cg12100791 | 31121918 | 16 | TRUE | 0.20 | 0.58 | 0.38 | 2.93 |
| RAB33A | 9363 | cg24340926 | 129132717 | X | TRUE | 0.13 | 0.53 | 0.40 | 4.20 |
| RAB34 | 83871 | cg21237418 | 24069170 | 17 | TRUE | 0.22 | 0.54 | 0.32 | 2.43 |
| RARA | 5914 | cg03085312 | 35718807 | 17 | FALSE | 0.15 | 0.53 | 0.38 | 3.51 |
| RARA | 5914 | cg00236832 | 35719015 | 17 | FALSE | 0.13 | 0.48 | 0.35 | 3.66 |
| RARB | 5915 | cg26124016 | 25444406 | 3 | TRUE | 0.08 | 0.39 | 0.32 | 5.23 |
| RARB | 5915 | cg27486427 | 25444923 | 3 | TRUE | 0.11 | 0.41 | 0.30 | 3.89 |
| RASL10B | 91608 | cg02927346 | 31083373 | 17 | TRUE | 0.10 | 0.47 | 0.37 | 4.73 |
| RASL12 | 51285 | cg10604168 | 63147423 | 15 | TRUE | 0.06 | 0.42 | 0.36 | 7.01 |
| RASSF5 | 83593 | cg17558126 | 204746873 | 1 | TRUE | 0.11 | 0.48 | 0.37 | 4.40 |
| RBP1 | 5947 | cg23363832 | 140741629 | 3 | TRUE | 0.25 | 0.58 | 0.33 | 2.32 |
| RGN | 9104 | cg09625066 | 46822515 | X | TRUE | 0.42 | 0.76 | 0.34 | 1.81 |
| RGN | 9104 | cg07654896 | 46822773 | X | TRUE | 0.26 | 0.71 | 0.45 | 2.69 |
| RHCG | 51458 | cg24653181 | 87840586 | 15 | TRUE | 0.26 | 0.61 | 0.35 | 2.35 |
| RHCG | 51458 | cg10453365 | 87840913 | 15 | TRUE | 0.20 | 0.61 | 0.41 | 3.00 |
| RND2 | 8153 | cg05270634 | 38430971 | 17 | TRUE | 0.07 | 0.64 | 0.57 | 9.70 |
| RP11-450P7.3 | 257240 | cg21655480 | 21586973 | X | TRUE | 0.13 | 0.46 | 0.33 | 3.44 |
| RPIP8 | 10900 | cg13102585 | 39741734 | 17 | TRUE | 0.16 | 0.54 | 0.38 | 3.29 |
| RPUSD3 | 285367 | cg26417554 | 9861232 | 3 | TRUE | 0.68 | 0.36 | 0.32 | 0.53 |
| RUSC2 | 9853 | cg15271616 | 35480515 | 9 | TRUE | 0.13 | 0.56 | 0.44 | 4.44 |
| SARM1 | 23098 | cg23887396 | 23723678 | 17 | TRUE | 0.04 | 0.35 | 0.31 | 8.13 |
| SART2 | 29940 | cg09025324 | 116798378 | 6 | TRUE | 0.11 | 0.52 | 0.41 | 4.66 |
| SCARF2 | 91179 | cg14785479 | 19122535 | 22 | TRUE | 0.08 | 0.52 | 0.44 | 6.66 |
| SCTR | 6344 | cg15250797 | 119997996 | 2 | TRUE | 0.13 | 0.44 | 0.31 | 3.39 |
| SCUBE3 | 222663 | cg00347904 | 35290486 | 6 | TRUE | 0.09 | 0.40 | 0.31 | 4.44 |
| SEMA5A | 9037 | cg03702236 | 9599755 | 5 | TRUE | 0.07 | 0.46 | 0.39 | 6.43 |
| SEPT9' | 10801 | cg04452095 | 72827463 | 17 | TRUE | 0.18 | 0.52 | 0.34 | 2.97 |
| SEPT9' | 10801 | cg03330678 | 72827828 | 17 | TRUE | 0.34 | 0.65 | 0.30 | 1.89 |
| SERPINB9 | 5272 | cg18676237 | 2848257 | 6 | TRUE | 0.06 | 0.39 | 0.33 | 6.75 |
| SFRP2 | 6423 | cg11354906 | 154929821 | 4 | TRUE | 0.10 | 0.44 | 0.34 | 4.37 |
| SFRP2 | 6423 | cg23207990 | 154929985 | 4 | TRUE | 0.10 | 0.41 | 0.31 | 4.15 |
| SHANK2 | 22941 | cg04396791 | 70185828 | 11 | TRUE | 0.23 | 0.56 | 0.32 | 2.37 |
| SIX6 | 4990 | cg19456540 | 60046038 | 14 | TRUE | 0.24 | 0.58 | 0.34 | 2.41 |
| SLC16A5 | 9121 | cg27619475 | 70595476 | 17 | TRUE | 0.08 | 0.48 | 0.41 | 6.33 |
| SLC16A5 | 9121 | cg09300114 | 70595924 | 17 | TRUE | 0.25 | 0.66 | 0.41 | 2.66 |
| SLC17A8 | 246213 | cg06563300 | 99274942 | 12 | FALSE | 0.14 | 0.45 | 0.32 | 3.27 |
| SLC19A3 | 80704 | cg25713185 | 228290730 | 2 | TRUE | 0.10 | 0.50 | 0.40 | 5.24 |
| SLC2A2 | 6514 | cg03699904 | 172228723 | 3 | TRUE | 0.08 | 0.43 | 0.35 | 5.55 |
| SLC34A2 | 10568 | cg19616230 | 25266527 | 4 | TRUE | 0.08 | 0.52 | 0.44 | 6.42 |
| SLC5A7 | 60482 | cg16232126 | 107969437 | 2 | TRUE | 0.12 | 0.49 | 0.37 | 4.15 |
| SLC6A3 | 6531 | cg13202751 | 1499443 | 5 | TRUE | 0.21 | 0.56 | 0.35 | 2.66 |
| SLC7A3 | 84889 | cg20622056 | 70067859 | X | TRUE | 0.12 | 0.45 | 0.33 | 3.66 |
| SLITRK1 | 114798 | cg07104706 | 83354128 | 13 | TRUE | 0.13 | 0.46 | 0.32 | 3.40 |
| SMARCA1 | 6594 | cg24447042 | 128485574 | X | TRUE | 0.19 | 0.55 | 0.35 | 2.81 |
| SNCAIP | 9627 | cg04747322 | 121675207 | 5 | TRUE | 0.12 | 0.44 | 0.31 | 3.59 |
| SOX17 | 64321 | cg02919422 | 55533097 | 8 | TRUE | 0.22 | 0.58 | 0.36 | 2.61 |
| SPAG6 | 9576 | cg25802093 | 22674044 | 10 | TRUE | 0.24 | 0.61 | 0.38 | 2.60 |
| SPATA6 | 54558 | cg09704415 | 48709837 | 1 | TRUE | 0.14 | 0.49 | 0.35 | 3.44 |
| SPDY1 | 245711 | cg04786857 | 28887401 | 2 | TRUE | 0.08 | 0.43 | 0.34 | 5.09 |
| SPG20 | 23111 | cg18755783 | 35817905 | 13 | TRUE | 0.11 | 0.45 | 0.33 | 3.97 |
| SST | 6750 | cg02164046 | 188870842 | 3 | TRUE | 0.10 | 0.55 | 0.45 | 5.71 |
| SSTR4 | 6754 | cg17586860 | 22963906 | 20 | TRUE | 0.11 | 0.52 | 0.41 | 4.80 |
| SSX4 | 6759 | cg10575735 | 48156567 | X | FALSE | 0.78 | 0.48 | 0.30 | 0.61 |
| ST6GALNAC3 | 256435 | cg12601757 | 76313053 | 1 | TRUE | 0.09 | 0.50 | 0.41 | 5.85 |
| ST8SIA5 | 29906 | cg19751300 | 42590397 | 18 | TRUE | 0.10 | 0.43 | 0.33 | 4.41 |
| SV2A | 9900 | cg01705587 | 148155988 | 1 | TRUE | 0.03 | 0.36 | 0.33 | 12.28 |
| SYN2 | 6854 | cg15873301 | 12020459 | 3 | TRUE | 0.04 | 0.42 | 0.37 | 10.11 |
| SYNGR1 | 9145 | cg19713460 | 38075476 | 22 | TRUE | 0.13 | 0.49 | 0.36 | 3.83 |
| TAC1 | 6863 | cg07550362 | 97199137 | 7 | TRUE | 0.11 | 0.41 | 0.30 | 3.65 |
| TACR2 | 6865 | cg26984805 | 70846507 | 10 | FALSE | 0.33 | 0.68 | 0.36 | 2.09 |
| TBX20 | 57057 | cg13870866 | 35259655 | 7 | TRUE | 0.16 | 0.51 | 0.35 | 3.17 |
| TDRD1 | 56165 | cg27547703 | 115929014 | 10 | TRUE | 0.74 | 0.41 | 0.34 | 0.55 |
| TLX3 | 30012 | cg25942450 | 170668856 | 5 | TRUE | 0.20 | 0.54 | 0.34 | 2.74 |

TABLE 1-continued

413 CpG sites differentially methylated between ADJ-N and PC samples with a Δβ of more than 0.3.

| SYMBOL | GENE ID | CpG site | MAPINFO | CHR | CPG ISLAND | Mean β ADJ-N | Mean β PC | Δβ | Xβ |
|---|---|---|---|---|---|---|---|---|---|
| TLX3 | 30012 | cg25720804 | 170668994 | 5 | TRUE | 0.12 | 0.65 | 0.52 | 5.24 |
| TMEM22 | 80723 | cg02672493 | 138020399 | 3 | TRUE | 0.17 | 0.48 | 0.31 | 2.77 |
| TMLHE | 55217 | cg06659128 | 154495729 | X | TRUE | 0.06 | 0.41 | 0.35 | 6.98 |
| TNFRSF10C | 8794 | cg16175263 | 23016330 | 8 | TRUE | 0.24 | 0.55 | 0.31 | 2.26 |
| TNFRSF10C | 8794 | cg05636175 | 23016342 | 8 | TRUE | 0.15 | 0.53 | 0.38 | 3.55 |
| TNFRSF10C | 8794 | cg27090216 | 23016406 | 8 | TRUE | 0.05 | 0.38 | 0.33 | 7.92 |
| TNFRSF10C | 8794 | cg14015044 | 23016564 | 8 | TRUE | 0.04 | 0.51 | 0.47 | 12.28 |
| TNS1 | 7145 | cg18328334 | 218516897 | 2 | FALSE | 0.24 | 0.58 | 0.34 | 2.40 |
| TP73 | 7161 | cg25115460 | 3596970 | 1 | TRUE | 0.41 | 0.77 | 0.35 | 1.85 |
| TP73 | 7161 | cg16607065 | 3597082 | 1 | TRUE | 0.21 | 0.55 | 0.34 | 2.59 |
| TP73 | 7161 | cg03846767 | 3597152 | 1 | TRUE | 0.34 | 0.71 | 0.37 | 2.09 |
| TPM4 | 7171 | cg26968812 | 16047873 | 19 | TRUE | 0.14 | 0.48 | 0.34 | 3.34 |
| TPM4 | 7171 | cg16232979 | 16048631 | 19 | TRUE | 0.20 | 0.67 | 0.47 | 3.39 |
| TRH | 7200 | cg01009664 | 131176303 | 3 | TRUE | 0.12 | 0.55 | 0.44 | 4.76 |
| TRHR | 7201 | cg22268164 | 110168926 | 8 | FALSE | 0.73 | 0.39 | 0.34 | 0.54 |
| TRIM29 | 23650 | cg13625403 | 119513720 | 11 | TRUE | 0.45 | 0.76 | 0.31 | 1.68 |
| TRIP6 | 7205 | cg01274660 | 100303561 | 7 | FALSE | 0.19 | 0.49 | 0.30 | 2.61 |
| TRPA1 | 8989 | cg01610488 | 73150424 | 8 | TRUE | 0.06 | 0.39 | 0.33 | 6.93 |
| TRPC1 | 7220 | cg24794531 | 143926527 | 3 | TRUE | 0.06 | 0.47 | 0.41 | 7.72 |
| TRPM3 | 80036 | cg16832407 | 72926359 | 9 | FALSE | 0.16 | 0.47 | 0.31 | 3.00 |
| TTC22 | 55001 | cg24697184 | 55039166 | 1 | TRUE | 0.06 | 0.45 | 0.39 | 7.22 |
| UBE2V2 | 7336 | cg25612480 | 49083013 | 8 | TRUE | 0.76 | 0.46 | 0.30 | 0.60 |
| UCHL1 | 7345 | cg24715245 | 40953551 | 4 | TRUE | 0.15 | 0.50 | 0.35 | 3.32 |
| UCN | 7349 | cg04527918 | 27384674 | 2 | TRUE | 0.36 | 0.71 | 0.35 | 1.96 |
| UGT3A1 | 133688 | cg23317501 | 36026972 | 5 | FALSE | 0.08 | 0.41 | 0.33 | 5.40 |
| UGT3A2 | 167127 | cg07084163 | 36102540 | 5 | TRUE | 0.15 | 0.49 | 0.33 | 3.18 |
| UNQ739 | 375567 | cg00333226 | 49784309 | 7 | TRUE | 0.10 | 0.43 | 0.33 | 4.39 |
| VGLL2 | 245806 | cg03160135 | 117693611 | 6 | TRUE | 0.12 | 0.42 | 0.30 | 3.58 |
| WDR40B | 139170 | cg22980351 | 125514720 | X | TRUE | 0.20 | 0.52 | 0.31 | 2.54 |
| WDR69 | 164781 | cg21577049 | 228444693 | 2 | TRUE | 0.07 | 0.42 | 0.35 | 6.01 |
| WFDC2 | 10406 | cg25799986 | 43531695 | 20 | TRUE | 0.22 | 0.59 | 0.37 | 2.74 |
| WFDC2 | 10406 | cg00980978 | 43532138 | 20 | TRUE | 0.09 | 0.48 | 0.39 | 5.30 |
| WNK3 | 65267 | cg12707233 | 54401689 | X | TRUE | 0.06 | 0.36 | 0.31 | 6.30 |
| ZFP42 | 132625 | cg06274159 | 189153861 | 4 | TRUE | 0.14 | 0.59 | 0.45 | 4.29 |
| ZIC3 | 7547 | cg13613682 | 136476219 | X | TRUE | 0.16 | 0.55 | 0.39 | 3.36 |
| ZNF154 | 7710 | cg21790626 | 62912306 | 19 | TRUE | 0.17 | 0.59 | 0.42 | 3.41 |
| ZNF154 | 7710 | cg08668790 | 62912474 | 19 | TRUE | 0.21 | 0.60 | 0.39 | 2.88 |
| ZNF436 | 80818 | cg10347418 | 23566513 | 1 | FALSE | 0.73 | 0.40 | 0.32 | 0.56 |
| ZNF454 | 285676 | cg03355526 | 178301021 | 5 | TRUE | 0.17 | 0.49 | 0.31 | 2.83 |
| ZNF541 | 84215 | cg22341310 | 52740395 | 19 | TRUE | 0.22 | 0.60 | 0.37 | 2.67 |
| ZNF553 | 197407 | cg16014085 | 30313623 | 16 | TRUE | 0.18 | 0.55 | 0.37 | 3.10 |
| ZNF577 | 84765 | cg16731240 | 57083062 | 19 | TRUE | 0.16 | 0.61 | 0.45 | 3.75 |
| ZNF660 | 285349 | cg22598028 | 44601496 | 3 | TRUE | 0.05 | 0.48 | 0.43 | 9.81 |
| ZNF96 | 9753 | cg02622316 | 28475389 | 6 | TRUE | 0.08 | 0.51 | 0.43 | 6.11 |

SYMBOL: gene symbol.

GENE ID: NCBI Gene ID.

CpG site: Infinium CpG site identification number.

MAPINFO: Chromosomal coordinate (hg18).

CHR: Chromosome.

CPG ISLAND: Infinium annotation of CpG site location relative to CpG islands.

Mean β ADJ-N: Mean β value of ADJ-N samples excluding smallest and largest value.

Mean β PC: Mean β value of PC samples excluding smallest and largest value.

Δβ: |(Mean β ADJ-N) − (Mean β PC)|.

Xβ: (Mean β PC)/(Mean β ADJ-N). Genes selected for further analysis in purple.

TABLE 2

Candidate hypermethylation markers

| Gene | GeneID | CpG site | Methylation Xβ | Δβ | RNA* Fold change in PC | Sign/total datasets |
|---|---|---|---|---|---|---|
| AOX1 | 316 | cg02144933 | 11.0 | 0.51 | −1.872 to −4.390 | 10/14 |
|  |  | cg12627583 | 9.9 | 0.49 |  |  |
| C1orf114 | 57821 | cg08047907 | 6.6 | 0.43 | −1.747 | 1/6 |
|  |  | cg13958426 | 8.0 | 0.41 |  |  |
| GAS6 | 2621 | cg26420196 | 8.2 | 0.55 | −1.556 to −2.969 | 3/15 |
| HAPLN3 | 145864 | cg08348496 | 19.7 | 0.47 | — | 0/6 |
|  |  | cg03698393* | 9.0 | 0.28 |  |  |
| ST6GALNAC3 | 256435 | cg12604757 | 5.8 | 0.41 | −1.784 | 1/5 |
| ZNF660 | 285349 | cg22598028 | 9.8 | 0.43 | — | 0/4 |

Candidates selected for validation.
Xβ: Mean β value of PC samples/mean β value of ADJ-N samples.
Δβ: Mean β value of PC samples − mean β value of ADJ-N samples.
*Δβ<0.3 but β-values significantly different between PC and ADJ-N samples.
*Datasets surveyed via oncomine.org, summary of significant (P < 0.05) RNA expression changes of more than 1.5 fold between PC and non-malignant samples.

TABLE 3

ROC curve analysis of non-malignant samples (ADJ-N and BPH) against clinically localized cancer samples (RP)

| Gene | AUC (95% CI) | Cutpoint | Sensitivity (95% CI) | Specificity (95% CI) |
|---|---|---|---|---|
| AOX 1 | 0.919 (0.875-0.962) | 0.542 | 0.952 (0.921-0.974) | 0.636 (0.451-0.796) |
|  |  | 1.246 | 0.713 (0.658-0.764) | 0.970 (fixed) (0.842-0.999) |
| C1orf114 | 0.892 (0.856-0.929) | 0.0001 | 0.860 (0.815-0.898) | 0.697 (0.513-0.844) |
|  |  | 0.104 | 0.775 (0.723-0.821) | 0.970 (fixed) (0.842-0.999) |
| GAS6 | 0.980 (0.966-0.994) | 0.111 | 0.969 (0.942-0.986) | 0.909 (0.757-0.981) |
|  |  | 0.288 | 0.932 (0.897-0.958) | 0.970 (fixed) (0.842-0.999) |
| HAPLN3 | 0.928 (0.895-0.960) | 0.006 | 0.932 (0.897-0.958) | 0.758 (0.577-0.889) |
|  |  | 0.266 | 0.710 (0.654-0.761) | 0.970 (fixed) (0.842-0.999) |

CI: confidence interval

TABLE 4

| PC samples | Cohort 1 (n = 293) | Cohort 2 (n = 114) |
|---|---|---|
| Median age (range) | 63 (46-73) | 63 (47-75) |
| Pathological Gleason score, n (%) |  |  |
| 3-6 | 113 (38.6) | 48 (42.1) |
| 7 | 143 (48.8) | 42 (36.8) |
| 8-10 | 36 (12.3) | 20 (17.5) |
| Unknown | 1 (0.3) | 4 (3.5) |
| Pathological T stage, n (%) |  |  |
| T1 | 0 (0.0) | 0 (0.0) |
| T2a-c | 184 (62.8) | 68 (59.6) |
| T3a-b | 106 (36.2) | 46 (40.4) |
| T4 | 3 (1.0) | 0 (0.0) |
| Unknown | 0 (0.0) | 0 (0.0) |
| PSA at diagnosis, n (%) |  |  |
| ≤10 ng/mL | 114 (38.9) | 66 (57.9) |
| >10 ng/mL | 178 (60.8) | 46 (40.4) |
| Unknown | 1 (0.3) | 2 (1.8) |
| Nodal status, n (%) |  |  |
| pN0 | 253 (86.3) | 40 (35.2) |
| pN1 | 5 (1.7) | 1 (0.9) |
| Unknown | 35 (11.9) | 73 (64.0) |
| Surgical margin status, n (%) |  |  |
| Negative | 196 (66.9) | 32 (28.1) |
| Positive | 93 (31.7) | 15 (13.2) |
| Unknown | 4 (1.4) | 67 (58.8) |
| Recurrence status, n (%) |  |  |
| No recurrence | 170 (58.0) | 58 (50.9) |
| Recurrence | 123 (42.0) | 56 (49.1) |
| Mean follow-up time, months (range) | 49 (2-151) | 70 (1-181) |

| Non-malignant samples | ADJ-N (n = 18) | BPH (n = 15) |
|---|---|---|
| Median Age (range) | 62 (56-72) | 70 (56-83) |

TABLE 5

Clinicopathological data for all non-RP samples in cohort 1

|  | ADJ-N n = 18 | BPH n = 15 | PIN n = 11 | MPC n = 17 | CRPC n = 28 |
|---|---|---|---|---|---|
| Median Age (range) | 62 (56-72) | 70 (56-83) | 63 (54-68) | 71 (52-89) | 73 (49-86) |
| Gleason score, n (%) |  |  |  |  |  |
| 3-6 | NA | NA | NA | 2 (11.8) | 0 (0.0) |
| 7 | NA | NA | NA | 4 (23.5) | 2 (7.1) |
| 8-10 | NA | NA | NA | 11 (64.7) | 26 (92.9) |
| Unknown | NA | NA | NA | 0 | 0 (0.0) |
| PSA at diagnosis, n (%) |  |  |  |  |  |
| ≤10 ng/mL | NA | NA | NA | 2 (11.8) | 1 (3.6) |
| >10 ng/mL | NA | NA | NA | 15 (88.2) | 9 (32.1) |
| Unknown | NA | NA | NA | 0 | 18 (64.3) |

NA: data not applicable.

TABLE 6

Correlation of methylation levels to clinicopathological parameters in cohort 1 and 2.

| Gene | Cohort | AOX 1 | C1orf114 | GAS6 | HAPLN3 |
|---|---|---|---|---|---|
| Age dichotomized (≤median<) Mann-Whitney P-value | 1 | 0.7741 | 0.2574 | 0.9465 | 0.8847 |
|  | 2 | 0.4904 | 0.6532 | 0.9293 | 0.9612 |
| Gleason score dichotomized (≤6<) Mann-Whitney P-value | 1 | 0.0003* | 0.3712 | 0.0175* | 0.0018* |
|  | 2 | 0.0794 | 0.1430 | 0.6383 | 0.4262 |
| T-stage dichotomized (≤2<) Mann-Whitney P-value | 1 | 0.0010* | <0.0001* | 0.0186* | 0.0649 |
|  | 2 | 0.0225* | 0.0190* | 0.0308* | 0.0069* |
| PSA Spearman's rho (P-value) | 1 | 0.1635 (0.0051)* | 0.3133 (<0.0001)* | 0.1455 (0.0128)* | 0.0614 (0.2959) |
|  | 2 | 0.0487 (0.6102) | 0.1052 (0.2694) | 0.1166 (0.2209) | 0.1431 (0.1324) |

Association of methylation markers with clinicopathological parameters.
*High methylation correlated positively with high Gleason score/T-stage/pre-operative PSA/Recurrence/positive resection margins.
[1]Only samples with recurrence/no recurrence within 48 months included.
ND: Data not available.

TABLE 8

Uni- and multivariate analysis of methylation markers as continuous variables in cohort 1 (training)

| | | Univariate analysis | | | Multivariate analysis | | |
|---|---|---|---|---|---|---|---|
| Variable | Characteristic | HR (95% CI) | P > \|z\| | Corr P | HR (95% CI) | P > \|z\| | Corr P |
| AOX1 | Cont. | 1.247 (1.002-1.552) | 0.048 | 0.192 | — | — | — |
| C1orf114 | Cont. | 4.737 (2.999-7.481) | <0.001 | <0.001 | 3.046 (1.819-5.101) | <0.001 | <0.001 |
| GAS6 | Cont. | 1.244 (0.842-1.840) | 0.273 | 0.273 | — | — | — |
| GSTP1 | Cont. | 1.670 (0.694-4.018) | 0.253 | 0.273 | — | — | — |
| HAPLN3 | Cont. | 1.617 (1.051-2.487) | 0.029 | 0.145 | — | — | — |
| KLF8 | Cont. | 1.710 (1.196-2.444) | 0.003 | 0.018 | 0.928 (0.576-1.495) | 0.758 | 0.758 |
| MOB3B | Cont. | 1.351 (0.793-2.303) | 0.268 | 0.273 | — | — | — |
| Preop. PSA | Cont. | 1.045 (1.032-1.058) | <0.001 | | | | |
| Tumor stage | pT2$_{a-c}$ vs pT3$_{a-}$ | 3.389 (2.353-4.880) | <0.001 | | | | |
| Gleason score | 5-6 vs 7-9 | 2.443 (1.583-3.772) | <0.001 | | | | |
| Surgical margin | Neg. vs pos. | 2.968 (2.062-4.272) | <0.001 | | | | |
| Nodal status | Neg. vs pos. | 3.293 (1.340-8.093) | 0.009 | | | | |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, Gleason score, Surgical margin, and Nodal status.

TABLE 8

Uni- and multivariate cox regression analysis of time to biochemical recurrence.

| | | Univariate | | | | Multivariate | | | |
|---|---|---|---|---|---|---|---|---|---|
| Variable | Characteristics | HR (95% CI) | P > \|z\| | Corr P | AUC | HR (95% CI) | P > \|z\| | Corr P | AUC |
| Cohort 1 | | | | | | | | | |
| C1orf114 | Cont. | 4.74 (3.00-7.48) | <0.001 | <0.001 | 0.73 | 3.10 (1.89-5.09) | <0.001 | <0.001 | 0.845 0.833 |
| Preop. PSA | Cont. | 1.04 (1.03-1.06) | <0.001 | | 0.76 | 1.04 (1.02-1.05) | <0.001 | | 0.824 0.816 |
| Tumor stage | pT2$_{a-c}$ vs pT3$_{a-b}$ | 3.39 (2.35-4.88) | <0.001 | | 0.70 | 1.74 (1.12-2.71) | 0.014 | | |
| Gleason sum | 5-6 vs 7-9 | 2.44 (1.58-3.77) | <0.001 | | 0.63 | 1.77 (1.13-2.77) | 0.013 | | |
| Surgical margin | Neg. vs pos. | 2.97 (2.06-4.27) | <0.001 | | 0.67 | 2.18 (1.42-3.35) | <0.001 | | |
| Nodal status | Neg. vs pos. | 3.29 (1.34-8.09) | 0.009 | | 0.52 | — | — | | |
| Cohort 2 | | | | | | | | | |
| C1orf114 | Cont. | 5.37 (1.99-14.5) | 0.001 | 0.004 | 0.74 | 3.27 (1.17-9.12) | 0.024 | 0.024 | 0.875 0.911 |
| Preop. PSA | Cont. | 1.02 (1.00-1.04) | 0.024 | | 0.69 | 1.03 (1.01-1.07) | 0.002 | | 0.863 0.899 |
| Tumor stage | pT2$_{a-c}$ vs pT3$_{a-b}$ | 3.81 (2.20-6.61) | <0.001 | | 0.78 | 3.52 (1.96-6.33) | <0.001 | | |
| Gleason score | 5-6 vs 7-9 | 2.90 (1.58-5.32) | 0.001 | | 0.73 | 3.04 (1.62-5.72) | 0.001 | | |
| Surgical margin | Neg. vs pos. | 2.08 (0.77-5.62) | 0.150 | | 0.61 | — | — | | |
| Nodal status | Neg. vs pos. | — | — | | — | — | — | | |
| Cohort 1 | | | | | | | | | |
| AO/C1/HA | low vs high meth | 2.58 (1.79-3.71) | <0.001 | | 0.69 | 1.91 (1.26-2.90) | 0.002 | 0.016 | 0.836 0.828 |
| Preop. PSA | Cont. | 1.04 (1.03-1.06) | <0.001 | | 0.76 | 1.04 (1.03-1.06) | <0.001 | | 0.824 0.816 |
| Tumor stage | pT2$_{a-c}$ vs pT3$_{a-b}$ | 3.39 (2.35-4.88) | <0.001 | | 0.70 | 1.99 (1.27-3.11) | 0.003 | | |

TABLE 8-continued

Uni- and multivariate cox regression analysis of time to biochemical recurrence.

|  |  | Univariate |  |  |  | Multivariate |  |  |  |
|---|---|---|---|---|---|---|---|---|---|
| Variable | Characteristics | HR (95% CI) | P > \|z\| | Corr P | AUC | HR (95% CI) | P > \|z\| | Corr P | AUC |
| Gleason sum | 5-6 vs 7-9 | 2.44 (1.58-3.77) | <0.001 |  | 0.63 | 1.50 (0.94-2.39) | 0.093 |  |  |
| Surgical margin | Neg. vs pos. | 2.97 (2.06-4.27) | <0.001 |  | 0.67 | 1.69 (1.09-2.63) | 0.019 |  |  |
| Nodal status | Neg. vs pos. | 3.29 (1.34-8.09) | 0.009 |  | 0.52 | 1.61 (0.57-4.53) | 0.368 |  |  |
| Cohort 2 |  |  |  |  |  |  |  |  |  |
| AO/C1/HA | low vs high meth | 2.64 (1.55-4.51) | <0.001 |  | 0.70 | 2.33 (1.31-4.13) | 0.004 | 0.004 | 0.869 0.906 |
| Preop. PSA | Cont. | 1.02 (1.00-1.04) | 0.024 |  | 0.69 | 1.03 (1.01-1.05) | 0.001 |  | 0.863 0.899 |
| Tumor stage | $pT2_{a-c}$ vs $pT3_{a-b}$ | 3.81 (2.20-6.61) | <0.001 |  | 0.78 | 3.76 (2.09-6.74) | <0.001 |  |  |
| Gleason score | 5-6 vs 7-9 | 2.90 (1.58-5.32) | 0.001 |  | 0.73 | 3.03 (1.61-5.73) | 0.001 |  |  |
| Surgical margin | Neg. vs pos. | 2.08 (0.77-5.62) | 0.150 |  | 0.61 | — | — |  |  |
| Nodal status | Neg. vs pos. | — | — |  | — | — | — |  |  |

HR: Hazard Ratio,
CI: Confidence Interval of HRs,
P > \|z\|: P-value of uni- or multivariate cox regression analysis,
Corr P: Hochberg corrected P-value.
AUC: Area under the curve calculated using recurrence status after 36 months follow-up.
AO/C1/HA: AOX1/C1orf114/HAPLN3. For cohort 2 lymph node status was not included as only one patient had cancer positive lymph nodes.

TABLE 9

Uni- and multivariate analysis of methylation markers as continuous variables in cohort 2 (validation)

|  |  | Univariate analysis |  |  | Multivariate analysis |  |  |
|---|---|---|---|---|---|---|---|
| Variable | Characteristics | HR (95% CI) | P > \|z\| | Corr P | HR (95% CI) | P > \|z\| | Corr P |
| C1orf114 | Cont. | 5.370 (1.988-14.505) | 0.001 | 0.002 | 3.267 (1.170-9.122) | 0.024 | 0.024 |
| KLF8 | Cont. | 3.308 (1.495-7.320) | 0.003 | 0.003 | 3.089 (1.271-7.508) | 0.013 | 0.026 |
| Preop. PSA | Cont. | 1.019 (1.002-1.036) | 0.024 |  |  |  |  |
| Tumor stage | $pT2_{a-c}$ vs $pT3_{a-b}$ | 3.813 (2.201-6.608) | <0.001 |  |  |  |  |
| Gleason score | 5-6 vs 7-9 | 2.900 (1.583-5.315) | 0.001 |  |  |  |  |
| Surgical margin | Neg. vs pos. | 2.077 (0.768-5.617) | 0.150 |  |  |  |  |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, and Gleason score.
Lymph node status was not included as only one patient had cancer positive lymph nodes in cohort 2.

TABLE 10

Uni- and multivariate cox regression analysis of dichotomized methylation markers in cohort 1 (training)

|  |  | Univariate analysis |  |  |  | Multivariate analysis |  |  | Multivariate analysis including C1orf114 |  |  |
|---|---|---|---|---|---|---|---|---|---|---|---|
| Variable | Characteristics | HR (95% CI) | P > \|z\| | Corr P | AUC | HR (95% CI) | P > \|z\| | Corr P | HR (95% CI) | P > \|z\| | AUC |
| AOX1 | low vs high meth | 1.69 (1.11-2.58) | 0.015 | 0.015 | 0.60 | 1.40 (0.88-2.21) | 0.151 | 0.314 | — | — |  |
| C1orf114 | low vs high meth | 2.77 (1.93-3.98) | <0.001 | <0.001 | 0.67 | 1.97 (1.31-2.94) | 0.001 | 0.004 | 1.97 (1.31-2.94) | 0.001 | 0.842 0.833 |
| HAPLN3 | low vs high meth | 1.83 (1.18-2.83) | 0.007 | 0.014 | 0.58 | 1.40 (0.85-2.29) | 0.184 | 0.314 | — | — |  |
| KLF8 | low vs high meth | 2.16 (1.35-3.47) | 0.001 | 0.003 | 0.57 | 1.32 (0.77-2.24) | 0.314 | 0.314 | — | — |  |
| Preop. PSA | Cont. | 1.05 (1.03-1.06) | <0.001 | — |  |  |  |  | 1.04 (1.02-1.05) | <0.001 | 0.824 0.816 |
| Tumor stage | $pT2_{a-c}$ vs $pT3_{a-b}$ | 3.39 (2.35-4.88) | <0.001 | — |  |  |  |  | 1.84 (1.16-2.92) | 0.010 |  |
| Gleason score | 5-6 vs 7-9 | 2.44 (1.58-3.77) | <0.001 | — |  |  |  |  | 1.64 (1.03-2.61) | 0.037 |  |

TABLE 10-continued

Uni- and multivariate cox regression analysis of dichotomized methylation markers in cohort 1 (training)

| Variable | Characteristics | Univariate analysis | | | | Multivariate analysis | | | Multivariate analysis including C1orf114 | | |
|---|---|---|---|---|---|---|---|---|---|---|---|
| | | HR (95% CI) | P > \|z\| | Corr P | AUC | HR (95% CI) | P > \|z\| | Corr P | HR (95% CI) | P > \|z\| | AUC |
| Surgical margin | Neg. vs pos. | 2.97 (2.06-4.27) | <0.001 | — | | | | | 1.96 (1.26-3.05) | 0.003 | |
| Nodal status | Neg. vs pos. | 3.29 (1.34-8.09) | 0.009 | — | | | | | 1.52 (0.54-4.23) | 0.432 | |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, Gleason score, Surgical margin, and Nodal status.

TABLE 11

Uni- and multivariate cox regression analysis of dichotomized methylation markers in cohort 2 (validation)

| Variable | Characteristics | Univariate analysis | | | | Multivariate analysis including C1orf114 | | |
|---|---|---|---|---|---|---|---|---|
| | | HR (95% CI) | P > \|z\| | Corr P | AUC | HR (95% CI) | P > \|z\| | AUC |
| AOX1 | low vs high meth | 1.732 (0.912-3.287) | 0.093 | 0.212 | 0.61 | — | — | |
| C1orf114 | low vs high meth | 2.105 (1.212-3.656) | 0.008 | 0.032 | 0.60 | 1.816 (1.006-3.279) | 0.048 | 0.857 0.900 |
| HAPLN3 | low vs high meth | 1.727 (0.890-3.353) | 0.106 | 0.212 | 0.58 | — | — | |
| KLF8 | low vs high meth | 1.444 (0.652-3.196) | 0.365 | 0.365 | 0.55 | — | — | |
| Preop. PSA | Cont. | 1.019 (1.002-1.036) | 0.024 | — | | 1.031 (1.012-1.051) | 0.002 | 0.863 0.899 |
| Tumor stage | pT2$_{a-c}$ vs pT3$_{a-b}$ | 3.813 (2.201-6.608) | <0.001 | — | | 3.775 (2.106-6.767) | <0.001 | |
| Gleason score | 5-6 vs 7-9 | 2.900 (1.583-5.315) | 0.001 | — | | 3.041 (1.614-5.731) | 0.001 | |
| Surgical margin | Neg. vs pos. | 2.077 (0.768-5.617) | 0.150 | — | | — | — | |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, and Gleason score. Lymph node status was not included as only one patient had cancer positive lymph nodes in cohort 2.

TABLE 12

Uni- and multivariate cox regression analysis of combinations of dichotomized methylation markers in cohort 1 (traning)

| | | Multivariate analysis | | |
|---|---|---|---|---|
| Variable | Characteristics | HR (95% CI) | P > \|z\| | Corr P |
| AO/C1 | low vs high meth | 2.01 (1.34-3.03) | 0.001 | 0.009 |
| AO/HA | low vs high meth | 1.25 (0.81-1.95) | 0.314 | 0.722 |
| AO/KL | low vs high meth | 1.10 (0.70-1.72) | 0.682 | 0.722 |
| C1/HA | low vs high meth | 2.11 (1.40-3.17) | <0.001 | <0.001 |
| C1/KL | low vs high meth | 2.01 (1.33-3.04) | 0.001 | 0.009 |
| HA/KL | low vs high meth | 1.22 (0.77-1.93) | 0.400 | 0.722 |
| AO/C1/HA | low vs high meth | 1.91 (1.26-2.90) | 0.002 | 0.016 |
| AO/C1/KL | low vs high meth | 1.74 (1.15-2.64) | 0.009 | 0.054 |
| AO/HA/KL | low vs high meth | 1.08 (0.70-1.67) | 0.722 | 0.722 |
| C1/HA/KL | low vs high meth | 1.91 (1.25-2.91) | 0.003 | 0.021 |
| AO/C1/HA/KL | low vs high meth | 1.70 (1.11-2.60) | 0.015 | 0.075 |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, Gleason score, Surgical margin, and Nodal status.
AO: AOX1,
C1: C1orf114,
HA: HAPLN3,
KL: KLF8.
Models significant after correction for multiple testing (Hochberg) in bold.

TABLE 13

Uni- and multivariate cox regression analysis of the C1orf114/HAPLN3 gene combination in cohort 1 (training) and cohort 2 (validation)

| | Variable | Characteristics | Univariate analysis | | | Multivariate analysis | | | |
|---|---|---|---|---|---|---|---|---|---|
| | | | HR (95% CI) | P > \|z\| | AUC | HR (95% CI) | P > \|z\| | Corr P | AUC |
| Cohort 1 | C1/HA | low vs high meth | 2.91 (2.03-4.17) | <0.001 | 0.70 | 2.11 (1.40-3.17) | <0.001 | <0.001 | 0.840 0.832 |
| | Preop. PSA | Cont. | 1.05 (1.03-1.06) | <0.001 | 0.76 | 1.04 (1.03-1.06) | <0.001 | | 0.824 0.816 |
| | Tumor stage | pT2$_{a-c}$ vs pT3$_{a-b}$ | 3.39 (2.35-4.88) | <0.001 | 0.70 | 2.02 (1.29-3.15) | 0.002 | | |
| | Gleason score | 5-6 vs 7-9 | 2.44 (1.58-3.77) | <0.001 | 0.63 | 1.54 (0.97-2.46) | 0.069 | | |

TABLE 13-continued

Uni- and multivariate cox regression analysis of the C1orf114/HAPLN3 gene combination in cohort 1 (training) and cohort 2 (validation)

| | | | Univariate analysis | | | Multivariate analysis | | | |
|---|---|---|---|---|---|---|---|---|---|
| | Variable | Characteristics | HR (95% CI) | P > \|z\| | AUC | HR (95% CI) | P > \|z\| | Corr P | AUC |
| Cohort 2 | Surgical margin | Neg. vs pos. | 2.97 (2.06-4.27) | <0.001 | 0.67 | 1.68 (1.08-2.59) | 0.021 | | |
| | Nodal status | Neg. vs pos. | 3.29 (1.34-8.09) | 0.009 | 0.52 | 1.46 (0.52-4.14) | 0.471 | | |
| | C1/HA | low vs high meth | 2.53 (1.48-4.33) | 0.001 | 0.67 | 2.26 (1.27-4.01) | 0.005 | 0.005 | 0.863 0.906 |
| | Preop. PSA | Cont. | 1.02 (1.00-1.04) | 0.024 | 0.69 | 1.03 (1.01-1.05) | 0.002 | | 0.863 0.899 |
| | Tumor stage | pT2$_{a-c}$ vs pT3$_{a-b}$ | 3.81 (2.20-6.61) | <0.001 | 0.78 | 3.70 (2.06-6.62) | <0.001 | | |
| | Gleason score | 5-6 vs 7-9 | 2.90 (1.58-5.32) | 0.001 | 0.73 | 3.14 (1.66-5.93) | <0.001 | | |
| | Surgical margin | Neg. vs pos. | 2.08 (0.77-5.62) | 0.150 | 0.61 | — | — | | |

HR: Hazard ratio,
CI: Confidence Interval,
Corr P: P-value corrected according to Hochberg.
Multivariate analysis: Individual methylation markers analyzed in multivariate analysis including Preop. PSA, Tumor stage, and Gleason score.
C1: C1orf114,
HA: HALN3. Lymph node status was not included as only one patient had cancer positive lymph nodes in cohort 2.

TABLE 14

Primer sequences used for amplification of chromatin immunoprecipitated DNA

| Amplicon | ChIP-qPCR primers Forward (pmol/reaction) | Reverse (pmol/reaction) |
|---|---|---|
| AOX1 | CTAAAGGCTGCGTTTTCAGG (2 pmol) SEQ ID NO: 24 | CTTGTGAGCCTTGGAAGGAG (2 pmol) SEQ ID NO: 25 |
| C1orf114 | GGGAGGGAGGGTAGGTAGTG (0.5 pmol) SEQ ID NO: 26 | TTACCAGACTTCCCCACCAG (0.5 pmol) SEQ ID NO: 27 |
| COL2A1 | GCTCTTTTCCACCAGCTTTG (0.5 pmol) SEQ ID NO: 28 | CTCGCGCTCTCTCTTTCCTA (0.5 pmol) SEQ ID NO: 29 |
| GAPDH | CTCTCTCCCATCCCTTCTCC (1 pmol) SEQ ID NO: 30 | CCTAGTCCCAGGGCTTTGAT (1 pmol) SEQ ID NO: 31 |
| GAS6 | CAGTGGGATTGGATCTGACC (2 pmol) SEQ ID NO: 32 | CCCGAATCTACTGCATCCTT (2 pmol) SEQ ID NO: 33 |
| HAPLN3 | ATCAGACTGCTGCCTTGGAC (0.5 pmol) SEQ ID NO: 34 | CAAAGCGGTAAGGGAGGAAC (0.5 pmol) SEQ ID NO: 35 |
| KLF8 | TATCTCCTCGTGGGTTCCTG (1 pmol) SEQ ID NO: 36 | TCCACCCATCCTCTGAACTC (1 pmol) SEQ ID NO: 37 |
| MOBKL2B | CCTGATCCTGAGGGAGGAGT (1.5 pmol) SEQ ID NO: 38 | TTGTTGGCCCCAAAGTTAAG (1.5 pmol) SEQ ID NO: 39 |

Reaction setup was as follows: 5 µl total = 2.5 µl Power SYBR Green PCR Master mix (Applied Biosystems).
PCR program: 2 min 50° C., 10 min 95° C., 40×(15 s 95° C., 1 min 60° C.), 15 s 95° C., 15 s 60° C., 15 s 95° C.

TABLE 15

ROC analysis of benign and malignant prostate tissue samples using methylation of both single genes and multi-gene models

| | | Cut-point 1 (most patients correctly classified) | | | Cut-point 2 (97% specificity) | | |
|---|---|---|---|---|---|---|---|
| Single genes/multi-gene models | AUC | Cut-point | Sens. | Spec. | Cut-point | Sens. | Spec. |
| AOX1 | 0.919 | 0.542 | 0.952 | 0.636 | 1.246 | 0.713 | 0.970 |
| C1orf114 | 0.892 | 0.000 | 0.860 | 0.697 | 0.104 | 0.775 | 0.970 |
| GAS6 | 0.980 | 0.111 | 0.969 | 0.909 | 0.288 | 0.932 | 0.970 |
| HAPLN3 | 0.928 | 0.006 | 0.932 | 0.758 | 0.266 | 0.710 | 0.970 |
| ST6GALNAC3 | | | | | | | |
| ZNF660 | | | | | | | |
| AOX1 C1orf114 | 0.940 | 0.515 | 0.959 | 0.636 | 1.322 | 0.829 | 0.970 |
| AOX1 GAS6 | 0.959 | 0.512 | 0.969 | 0.606 | 1.279 | 0.894 | 0.970 |
| AOX1 HAPLN3 | 0.943 | 0.542 | 0.963 | 0.636 | 1.446 | 0.802 | 0.970 |
| AOX1 ST6GALNAC3 | | | | | | | |
| AOX1 ZNF660 | | | | | | | |
| C1orf114 GAS6 | 0.980 | 0.048 | 0.983 | 0.818 | 0.357 | 0.939 | 0.970 |

TABLE 15-continued

ROC analysis of benign and malignant prostate tissue samples using methylation of both single genes and multi-gene models

| Single genes/multi-gene models | AUC | Cut-point 1 (most patients correctly classified) | | | Cut-point 2 (97% specificity) | | |
|---|---|---|---|---|---|---|---|
| | | Cut-point | Sens. | Spec. | Cut-point | Sens. | Spec. |
| C1orf114 HAPLN3 | 0.959 | 0.035 | 0.966 | 0.758 | 0.356 | 0.836 | 0.970 |
| C1orf114 ST6GALNAC3 | | | | | | | |
| C1orf114 ZNF660 | | | | | | | |
| GAS6 HAPLN3 | 0.980 | 0.100 | 0.976 | 0.849 | 0.385 | 0.939 | 0.970 |
| GAS6 ST6GALNAC3 | | | | | | | |
| GAS6 ZNF660 | | | | | | | |
| HAPLN3 ST6GALNAC3 | | | | | | | |
| HAPLN3 ZNF660 | | | | | | | |
| ST6GALNAC3 ZNF660 | | | | | | | |
| AOX1 C1orf114 GAS6 | 0.963 | 0.731 | 0.956 | 0.758 | 1.650 | 0.864 | 0.970 |
| AOX1 C1orf114 HAPLN3 | 0.952 | 0.515 | 0.966 | 0.636 | 1.507 | 0.833 | 0.970 |
| AOX1 C1orf114 ST6GALNAC3 | | | | | | | |
| AOX1 C1orf114 ZNF660 | | | | | | | |
| AOX1 GAS6 HAPLN3 | 0.964 | 0.568 | 0.973 | 0.636 | 1.541 | 0.877 | 0.970 |
| AOX1 GAS6 ST6GALNAC3 | | | | | | | |
| AOX1 GAS6 ZNF660 | | | | | | | |
| AOX1 HAPLN3 ST6GALNAC3 | | | | | | | |
| AOX1 HAPLN3 ZNF660 | | | | | | | |
| AOX1 ST6GALNAC3 ZNF660 | | | | | | | |
| C1orf114 GAS6 HAPLN3 | 0.980 | 0.131 | 0.977 | 0.879 | 0.396 | 0.945 | 0.970 |
| C1orf114 GAS6 ST6GALNAC3 | | | | | | | |
| C1orf114 GAS6 ZNF660 | | | | | | | |
| C1orf114 HAPLN3 ST6GALNAC3 | | | | | | | |
| C1orf114 HAPLN3 ZNF660 | | | | | | | |
| C1orf114 ST6GALNAC3 ZNF660 | | | | | | | |
| GAS6 HAPLN3 ST6GALNAC3 | | | | | | | |
| GAS6 HAPLN3 ZNF660 | | | | | | | |
| GAS6 ST6GALNAC3 ZNF660 | | | | | | | |
| HAPLN3 ST6GALNAC3 ZNF660 | | | | | | | |
| AOX1 C1orf114 GAS6 HAPLN3 | 0.966 | 0.690 | 0.963 | 0.697 | 1.753 | 0.877 | 0.970 |
| AOX1 C1orf114 GAS6 ST6GALNAC3 | | | | | | | |
| AOX1 C1orf114 GAS6 ZNF660 | | | | | | | |
| AOX1 C1orf114 HAPLN3 ST6GALNAC3 | | | | | | | |
| AOX1 C1orf114 HAPLN3 ZNF660 | | | | | | | |
| AOX1 C1orf114 ST6GALNAC3 ZNF660 | | | | | | | |
| AOX1 GAS6 HAPLN3 ST6GALNAC3 | | | | | | | |
| AOX1 GAS6 HAPLN3 ZNF660 | | | | | | | |
| AOX1 GAS6 ST6GALNAC3 ZNF660 | | | | | | | |
| AOX1 HAPLN3 ST6GALNAC3 ZNF660 | | | | | | | |
| C1orf114 GAS6 HAPLN3 ST6GALNAC3 | | | | | | | |
| C1orf114 GAS6 HAPLN3 ZNF660 | | | | | | | |
| C1orf114 GAS6 ST6GALNAC3 ZNF660 | | | | | | | |
| C1orf114 HAPLN3 ST6GALNAC3 ZNF660 | | | | | | | |
| GAS6 HAPLN3 ST6GALNAC3 ZNF660 | | | | | | | |
| AOX1 C1orf114 GAS6 HAPLN3 ST6GALNAC3 | | | | | | | |
| AOX1 C1orf114 GAS6 HAPLN3 ZNF660 | | | | | | | |
| AOX1 C1orf114 GAS6 ST6GALNAC3 ZNF660 | | | | | | | |
| AOX1 C1orf114 HAPLN3 ST6GALNAC3 ZNF660 | | | | | | | |
| AOX1 GAS6 HAPLN3 ST6GALNAC3 ZNF660 | | | | | | | |
| C1orf114 GAS6 HAPLN3 ST6GALNAC3 ZNF660 | | | | | | | |
| AOX1 C1orf114 GAS6 HAPLN3 ST6GALNAC3 ZNF660 | | | | | | | |

AUC: Area under the curve of receiver operating characteristic (ROC) analysis of 35 benign prostate tissue samples versus 293 prostate cancer samples.
Sens: sensitivity of methylation for prostate cancer at given cut-point.
Spec: specificity of methylation for prostate cancer at given cut-point. Combinations of genes were generated by adding methylation values for each individual gene.

TABLE 16

Single genes and multi-gene models in uni- and multivariate cox regression analysis of time to PSA recurrence after radical prostatectomy.

| Single genes/multi-gene models | Cohort 1 Univariate hazard ratio (95% CI) | Cohort 1 Multivariate hazard ratio (95% CI) | Cohort 2 Univariate hazard ratio (95% CI) | Cohort 2 Multivariate hazard ratio (95% CI) |
|---|---|---|---|---|
| AOX1 | 1.68 (1.11-2.58) | 1.40 (0.88-2.21) | 2.10 (1.24-3.55) | 1.79 (0.96-3.34) |
| C1orf114 | 2.77 (1.93-3.98) | 1.96 (1.31-2.94) | 2.01 (1.23-3.29) | 2.10 (1.21-3.66) |
| GAS6 | 1.87 (1.03-3.27) | 1.19 (0.64-2.20) | 1.35 (0.62-2.94) | 1.40 (0.56-3.52) |
| HAPLN3 | 1.83 (1.18-2.83) | 1.40 (0.85-2.29) | 1.98 (1.11-3.51) | 1.73 (0.89-3.35) |
| ST6GALNAC3 | | | | |
| ZNF660 | | | | |
| AOX1 C1orf114 | 2.71 (1.89-3.89) | 2.01 (1.34-3.03) | 2.39 (1.49-3.84) | 2.13 (1.24-3.65) |
| AOX1 GAS6 | 1.75 (1.16-2.62) | 1.42 (0.91-2.20) | 1.82 (1.07-3.09) | 1.70 (0.93-3.12) |
| AOX1 HAPLN3 | 1.56 (1.05-2.31) | 1.25 (0.81-1.95) | 2.56 (1.58-4.16) | 2.24 (1.29-3.89) |
| AOX1 ST6GALNAC3 | | | | |
| AOX1 ZNF660 | | | | |
| C1orf114 GAS6 | 2.63 (1.84-3.77) | 1.82 (1.21-2.72) | 2.18 (1.34-3.54) | 2.23 (1.29-3.86) |
| C1orf114 HAPLN3 | 2.91 (2.03-4.17) | 2.11 (1.40-3.17) | 2.59 (1.60-4.18) | 2.53 (1.48-4.33) |
| C1orf114 ST6GALNAC3 | | | | |
| C1orf114 ZNF660 | | | | |
| GAS6 HAPLN3 | 1.67 (1.11-2.53) | 1.23 (0.77-1.95) | 2.16 (1.27-3.67) | 2.01 (1.07-3.76) |
| GAS6 ST6GALNAC3 | | | | |
| GAS6 ZNF660 | | | | |
| HAPLN3 ST6GALNAC3 | | | | |
| HAPLN3 ZNF660 | | | | |
| ST6GALNAC3 ZNF660 | | | | |
| AOX1 C1orf114 GAS6 | 2.66 (1.85-3.81) | 2.01 (1.34-3.03) | 2.39 (1.49-3.84) | 2.13 (1.24-3.65) |
| AOX1 C1orf114 HAPLN3 | 2.58 (1.79-3.71) | 1.91 (1.26-2.90) | 2.85 (1.77-4.58) | 2.64 (1.55-4.51) |
| AOX1 C1orf114 ST6GALNAC3 | | | | |
| AOX1 C1orf114 ZNF660 | | | | |
| AOX1 GAS6 HAPLN3 | 1.54 (1.04-0.66) | 1.25 (0.81-1.91) | 2.41 (1.49-3.91) | 2.24 (1.29-3.89) |
| AOX1 GAS6 ST6GALNAC3 | | | | |
| AOX1 GAS6 ZNF660 | | | | |
| AOX1 HAPLN3 ST6GALNAC3 | | | | |
| AOX1 HAPLN3 ZNF660 | | | | |
| AOX1 ST6GALNAC3 ZNF660 | | | | |
| C1orf114 GAS6 HAPLN3 | 2.75 (1.91-3.94) | 2.01 (1.33-3.04) | 2.71 (1.68-4.38) | 2.68 (1.57-5.48) |
| C1orf114 GAS6 ST6GALNAC3 | | | | |
| C1orf114 GAS6 ZNF660 | | | | |
| C1orf114 HAPLN3 ST6GALNAC3 | | | | |
| C1orf114 HAPLN3 ZNF660 | | | | |
| C1orf114 ST6GALNAC3 ZNF660 | | | | |
| GAS6 HAPLN3 ST6GALNAC3 | | | | |
| GAS6 HAPLN3 ZNF660 | | | | |
| GAS6 ST6GALNAC3 ZNF660 | | | | |
| HAPLN3 ST6GALNAC3 ZNF660 | | | | |
| AOX1 C1orf114 GAS6 HAPLN3 | 2.53 (1.76-3.64) | 1.91 (1.26-2.90) | 2.85 (1.77-4.58) | 2.64 (1.55-4.51) |
| AOX1 C1orf114 GAS6 ST6GALNAC3 | | | | |
| AOX1 C1orf114 GAS6 ZNF660 | | | | |
| AOX1 C1orf114 HAPLN3 ST6GALNAC3 | | | | |
| AOX1 C1orf114 HAPLN3 ZNF660 | | | | |
| AOX1 C1orf114 ST6GALNAC3 ZNF660 | | | | |
| AOX1 GAS6 HAPLN3 ST6GALNAC3 | | | | |
| AOX1 GAS6 HAPLN3 ZNF660 | | | | |
| AOX1 GAS6 ST6GALNAC3 ZNF660 | | | | |
| AOX1 HAPLN3 | | | | |

TABLE 16-continued

Single genes and multi-gene models in uni- and multivariate cox regression analysis of time to PSA recurrence after radical prostatectomy.

| Single genes/multi-gene models | Cohort 1 Univariate hazard ratio (95% CI) | Cohort 1 Multivariate hazard ratio (95% CI) | Cohort 2 Univariate hazard ratio (95% CI) | Cohort 2 Multivariate hazard ratio (95% CI) |
|---|---|---|---|---|
| ST6GALNAC3 ZNF660 C1orf114 GAS6 HAPLN3 | | | | |
| ST6GALNAC3 C1orf114 GAS6 HAPLN3 ZNF660 | | | | |
| C1orf114 GAS6 ST6GALNAC3 ZNF660 | | | | |
| C1orf114 HAPLN3 ST6GALNAC3 ZNF660 | | | | |
| GAS6 HAPLN3 ST6GALNAC3 ZNF660 | | | | |
| AOX1 C1orf114 GAS6 HAPLN3 ST6GALNAC3 | | | | |
| AOX1 C1orf114 GAS6 HAPLN3 ZNF660 | | | | |
| AOX1 C1orf114 GAS6 ST6GALNAC3 ZNF660 | | | | |
| AOX1 C1orf114 HAPLN3 ST6GALNAC3 ZNF660 | | | | |
| AOX1 GAS6 HAPLN3 ST6GALNAC3 ZNF660 | | | | |
| C1orf114 GAS6 HAPLN3 ST6GALNAC3 ZNF660 | | | | |
| AOX1 C1orf114 GAS6 HAPLN3 ST6GALNAC3 ZNF660 | | | | |

Multi-gene models: For each gene, cohort 1 patients were dichotomized into high and low methylation groups by ROC analysis of recurrence/non-recurrence status at 36 months follow-up. For multi-gene models, patients were included in the high methylation group if at least one gene was annotated as highly methylated by ROC analysis. Cohort 2 patients were dichotomized on the basis of cut-offs (fractions) defined in cohort 1.
CI: confidence interval.

TABLE 17

Primer and probe sequences of bisulfite sequencing and qMSP assays.

| Gene | Bisulfite sequencing primers Sense primer | Bisulfite sequencing primers Antisense primer | qMSP primers and probes Sense (pmol/ reaction) | qMSP primers and probes Antisense (pmol/ reaction) | qMSP primers and probes Probe (pmol/ reaction) | Reac. Vol. and Cond. |
|---|---|---|---|---|---|---|
| AOX1 | GGGAAGAGTTTT TGGTAAAGAGTTT (SEQ ID NO: 40) | ATAAAAACCCAA AAATCCAAAACAA (SEQ ID NO: 41) | TTTCGTAATAG CGGTTTTGT (6 pmol) (SEQ ID NO: 42) | CAAAACAATCC CTAAAAACG (6 pmol) (SEQ ID NO: 43) | HEX_TCGTATTT TTATTTTTGTTT TCGGG_BHQ1 (1 pmol) (SEQ ID NO: 44) | 5 µl[3] |
| C1orf114 | TTTTTATATTGAG GTAAAGGAGATTT (SEQ ID NO: 45) | AAAAAAATTTCAC AACCAACACAA (SEQ ID NO: 46) | ATTTGCGTAGG CGTATGTAA (3 pmol) (SEQ ID NO: 47) | CGTAAATTCCT TAATCGTCCC (3 pmol) (SEQ ID NO: 48) | HEX_TCGGTGT TTGCGAAGGGT TAG_BHQ1 (1 pmol) (SEQ ID NO: 49) | 5 µl[4] |
| GAS6 | GGTAGTAGGTTTA AAAATAAGATTT (SEQ ID NO: 50) | CTATAAAATCAC CCTAACTTCAAA (SEQ ID NO: 51) | GGTTTCGTTTT GTTAGGTGT (3 pmol) (SEQ ID NO: 52) | ATTCCTAACCG AAATACCG (3 pmol) (SEQ ID NO: 53) | FAM_GCGGGTG TTTTTAGGAGTT CG_BHQ1 (1 pmol) (SEQ ID NO: 54) | 5 µl[3] |
| HAPLN3 | GATTTTGGTAGG AAGGGGGT | CCCAACCCTTAA AAAAAAAAAATA | CTTTTCGTAGT GTTCGGTTTAC (3 pmol) | GAATTCCTCCC TTACCGC | HEX_TCGGATTT TGTTCGGGAGG T_BHQ1 (1 pmol) | 5 µl[3] |

TABLE 17-continued

Primer and probe sequences of bisulfite sequencing and qMSP assays.

| | Bisulfite sequencing primers | | qMSP primers and probes | | | |
|---|---|---|---|---|---|---|
| Gene | Sense primer | Antisense primer | Sense (pmol/ reaction) | Antisense (pmol/ reaction) | Probe (pmol/ reaction) | Reac. Vol. and Cond. |
| MYOD1 | — | — | CCAACTCCAAA TCCCCTCTCTA T[1] (3 pmol) (SEQ ID NO: 60) | TGGTTTTTTTA GGGAGTAAGTT TGTT[2] (3 pmol) (SEQ ID NO: 61) | FAM_TCCCTTC CTATTCCTAAAT CCAACCTAAAT ACCTCC_BHQ1[1] (1 pmol) (SEQ ID NO: 62) | 5 µl[3] |
| ST6G ALNA C3 | GAAAGAAGTAGT AGGTATTGAGGA GT (1) (SEQ ID NO: 63) TTTGTTTTTAGG ATTGTTTTTGATT T (2) (SEQ ID NO: 64) | TTACCTTCAAAAT ACAAACCATAA (1) (SEQ ID NO: 65) CATATTTCAAAAT CTCCCTCCATAT A (2) (SEQ ID NO: 66) | — | — | — | — |
| ZNF6 60 | GGGTATAGAGAT GTGGAAATTTT (SEQ ID NO: 67) | CCCAAAACAAAA AAACAACACTA (SEQ ID NO: 68) | — | — | — | — |

Reac. Vol. and Cond.: Reaction volumes and conditions.
[1]Primer/probe sequence from: Jeronimo, C., et al., Quantitation of GSTP1 methylation in non-neoplastic prostatic tissue and organ-confined prostate adenocarcinoma. J Natl Cancer Inst, 2001. 93(22): p. 1747-52.
[2]MYOD1 reverse primer was redesigned to produce a shorter amplicon.
[3]PCR program: 10 min 95° C., 50×(15 s 95° C., 1 min 56° C., 30 s 72° C.).
[4]PCR program: 10 min 95° C., 50×(15 s 95° C., 1 min 58° C., 30 s 72° C.), and for GSTP1 as previously described (Jeronimo, C., et al., Quantitation of GSTP1 methylation in non-neoplastic prostatic tissue and organ-confined prostate adenocarcinoma. J Natl Cancer Inst, 2001. 93(22): p. 1747-52).

SEQUENCE LISTING (68 sequences)

SEQ ID NO: 1 - DNA, 90487 bp, Homo sapiens
  misc_feature (1)..(90487): DNA nucleotide sequence of the entire AOX1 genomic locus including 5000-bp upstream sequence
aggtagatgaacctttctggttttttgtttttatttgtaaatctagttttattgcattttggtcagaaattatttattgtaatatttctgctttatggaaattgccagtattttctttgtgacctactataggatcagcatttataactgtgctgtgattgcttagatgtatattctccataatcaaggtctaaagtttgatatatatccatgagatttactgtatttattatgttgcttagatcttctgtttcttattttttgtaaataagtgatctgttttgtactaaggttatactaagagttgtatattaaaatctactgtgtcctgtgtttccatgtatctcctgtagtttttgcttcagaagggtggttgctctgctttttgctatgtaaatatcatgattattacttattcattttggattatggcctttattatattaaaaatgtcctcatttgtcatgttcagtgctctggactaaagacttaaagtctttaagatataaagactttaaaaacatatttatgagaccttcctgataactcctaccactcctatcttcaatacctatgatgatcattccataatagcaagcagctttaattaggatgtactttcatgggagctactagaagctgtgatatacctagtgtataccatttccaatccaaaaagaaggaagaaaaaaaagtggcaactggatggtcatcactcggaatttatactgaatgttgtggcttttgcttttaaaaattttaccaactaagctgtatagcaaatcatctgcatgcactgtacatttaaactaaaatagaaccttatttccttacagcattttgctgtgttttatttagaataggtacttcttttgaaaggattaattaaactctatctaattacccaaggcagtggtatcacactggctctgaagaggagtacgaaggagtgaaagagacctttccacctaatcttgtatacctttttaaatttgggaccatgtctatgtatttcatctaaaaaccacatttacacacatgcatgtaaaatataactaaactccataacttgaaacatgatgtattaggtgcaggaatctaccctcttactgaaaaaataaaattattgggtaaaatactaaaaaacataccttgaatgcatttcttaactaatgactattagccaaccaacatttcttttagtaggaaagtaagaaaagctcagatcaaagatcaaatgatagcaggaactcagaggggaactgaccttatcctgaagatatttgtctaactaggtgaacctaaacattgcattcacaaccctatggggctagggacagaagacaaatcctagggtttatccaaaataaatagtctaatagatcttcttccataaagttgatctactttctcagtaaaagagcaaactaaaaataacctccccactagcttgctcagccccaggaaataacttgggtgctgaattaaggaggaaaaaaatctttccttagaattcataaccaaaatacagcctttattgcagattatagctggaattcacaatatttcgaaggcaaaaaaaaagttaagctgaggatttagtataattagtgcatgaactatagtgctctgttgtctattagaagcaaatattttgtagggagttgtccatctcacacctcaacatgttttgcacagccaaagttccaaggaaaatgaagggctacctcatagtaaagaaaaacattacatacacaggggaacaaggtatcagcagaaacagcaatcagacacagaatataaaatgtttaatgtttcaataaaggagaggcttgaaaatgaatgaagatgttgagtggaaaaagtcacagaaaaacacctacagtacgattccatttatataaagatatctatcaaacagataaaaccaaacaatatactttgtgggagagcaatacacaaacgcttaaaacaaaactgtaaagaaaggagtgataatagaattcaggatagtggtccctttttgggggaggagagggttgtgatcagaaaggggcatattggaggtgtggtaatattttgtttcttaacctgggtgtaggaacatgagcatttactttgtttttaaatggtatattttcacatgttcttgaacatatgctaaatttctaacaaaaaggaactatgtaataaacatgtaatatataaaatctatgttgattaatttttcttaaatatttgaaatgaattatttgaagtactctgatagtgagaactataagatttaagaaaaattagagtatttcaagtatttaacaaagcttatggtttaaggaaacttcttttctactgatatgatgaaacaattttcttctccatgcttcacagcaaaagcattaattttgggttgttattaatcttcctttttttctactttgcagcaagatgagaagatgaagtgaatttatggattctggtttttctgaattttcaaagcataaggaatcaaaacagaaatatagtatcaagaagatgaaatgcttaatgaaaaggttttttttttgtttctttggcctttcatggagtgttgatttgtccattcttaatgtttattaataggtatatgtgcataaaatagctattttgtaacattaaactttttgagtcattttggtcatcatataacttaccttcctgtttatttaagcttctttttacctagtagcctttaaccaaacaataaccttttaaccaaataaaatgtgttaataaatacctttgcattggttatcttgtatactaggctgtcttgttttgctgtctgtttttaacccattcaatatatgtggacatccaaaagggtttaaaagccacctcctgccctggcccgttttctctcccttcattcttctgttttcagaaatacatgttgaatgtcagcttctgtattatttctattatatgtaatctgatgacttagaggaggagattaacctttcaggctcttttgaatttggtttttataatttggttttaaagatcacttactcttccagtaataagtagtaataaatcctgttcatatctgagatcaatacacagtttattgaattcaaatgactactcaaactctattccacctagatggaaaacttttttagacaatatctgaccactaacgcggtgggcccagaaatctgcatcttaatcagatgcttcaggtgagtccgtccgaggattgtcctagtaccacactttgagagactgcagtgggggtacagagtgctggaggggtttagtcaatagctctagtgaaggatggatagttttattcaaagaatcccagttgatgaatgaagaagaaatgctagaattagaaaaattgcaaacccctattaaaactaccgctcaggcaatgctcaacaatggatgtaaaacaattaggtgaaatgttgatggagaaattcattacaaaggaatagccctctgaacccactgatcaatgttagcatcattacgaatgaaacaaccagacaccatatgcttcctgctgtgctgcaatattaattatatggtaccacctatgaagtgttcttgccctctcccccccaaaaaattgaacctgaatttaatcaaagctttagatctaatatttagtgcataggaaataagtagagtagaaaaacaataccagggagaagcaattagccacattcaaaaaatggttcatttcaatagaacaactgacctggtttctttttcaatgtgttaatagtgttaaaaagtctgttttagatcaaaagagactgatgagaccacatgcaaatacattgcacagctcttgtttgattcaaagaagtcaagtgtaaaagacattttttagacacgtgaaatggtgttgcggctgactaaaaggatgtgtatgtgtgtttttgaagtatttagggctaaaatatgtccaggattggcttttaaatactacaaaaaatggagtatgccaaaacgttgaccattgttaaagctcagtgaagggcaggtagatgccaattgcactcttcacttttatgtgcaaagtttggaaaatttcacaataaaatttttgtgtttacataaatgaaataacatgggaaaatgttctaaggtatggcaagtgaaaaaagcctggaaaataactagtttgtcccacttaagtttttaaaggtgttaaaagtacatgtttcaaaaagtaaggatagactaaaaaagtgaacggtggtaagttctaagttgtgggcttacaggtgttctttatttttatgctttgctgtattttccaagtttttttttttaagttttccaagatgttttacatctctgttcttatttaccagataaactttgtggttagttactggataaactgtaaatagtgataaaatttttaagtttatatcaagatagcacttcattttaaaaccagtaattattaggttggtgcaaaattaattgcagttgttgccattggaagtgatggtaaaaaccgcaattacttttgcaccaaccttatatttctaaaagatcaagttgtaaacctatttgttttccctaagatccgctcttgcagagttggaataaatatgattgtttacacttaagagtccaggactacagcaggcctggttggaggggagttactaatgttcccagacttaaatccagctggaacaccacctaaaatatgcagtaacataagaccatcaaaagcaatgtcccaggacttacaatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggccggggcagagaggagcccctgccgttcgtcccatcctttcgtgcccgccgtttaaggcactcaggcacggactggctttctcccgtaacagcggctttgccttcgcattcccacccctgcctccggggcagctaaaggctgcgttttcagggactgtcctggatctttgggcccccaccttccttatgttcccctttcctctccttccaaggctcacaagctgatttccaaccacacgccctccctaaacagtaagataaaaagtattcttgcccatcaggggtcagcactcccagatcttcgttccctcaatcccagccgataacgggaacgtccccagtacactgagagcagcctacagaaatggctgagcctcagctcgcggggtgcgtttggaagcgcagagagcaacttagattcgggacaagaccgtagagacgaacacattcaaaccacccccatcgtttctcagatgaagaaatcgttactttccaaagtcacagctagttcctggcagagctgaacccaagtcaggctctgggggctccaaggtcctcacgggttccactgctgggtgcgggctctgtcgcctcagaagctgggctcgctctgcgcaacccgagggacagttccaggcagtgtccgatgtttgggagaagcaaagccccctgggcatcctttaaaacaccccccttaatgtgagcatcaactctgctcactcttaatgttccagtttcattgacattactctgaaggaggaaactgaggcaggaaggttaaggagctcccttgagagctgtggctcacgcctgtaatctgcactttgggagaccgaggcaggaggattgcttgagcccaggagttcgagtttagcctgggcaacatggcgaaaccttgtctctacaaaaaaaaaaccaaacaaaacaaaacaacaacaacaaaaaaaaaccggtgtggtggtgcgtgcctgcagcccagctactggggagggtgaaggaggattgcttgagtctaggagttcaaggttacagtgagctgtgatcacaccactgcactccagcttggacaaaagagtgagatcctatttcttaaaaacaacaaaaacagagctaacaaccaagcaagagcagtggcacctgatttccctggtgctcgtgttggtgccggttcattcagagccacctgtgaccactgcttctggctaagggcagccacaacacttttcccgacgggcaccagctgcctcccctggaagctaaccagtgtgaagcaccaggccctagttgtgaggcctgttctaagaccctgagcctaatttcatttgtggttttgtattatgtttcttaaagaggatcccccaaattgtacattaggcccctcaaaaactttgtctgcccctgctgcctgggttctacattggataagatgagctagtttttcctgatctgtaagggtcattaggaccccttcacaggactgctgtgagggtgaaatatgacaatggggtgagatgattgacattatgtcatttttttcttcttttgcataatagaatggtatagtaaacacaacactggctttgttgtttagacaaacaagtcttcaattccaattctaattctgattgagaaaacctaacctctcagaggcccagtttctctgttaaaaggggatcataccacttacttcataaagagtgatcatgagcattcaatccacttatttgttaagggcctaccgtatgccagtcagtgttccaggcttatgagatacagcagagcacagaaataacaagtccttgcgtgcatggagcttacattgtgctggggagatagcaagcatataaatacgtggaaatgtgtaatgtcaggaagtgagaagtgctaatataaaaaataaagcacagcgtggggacagagagtatgcaggatacttagaggggatggatgttttggcctgtctgaaagggtggcatttgagcagtgactgggatgcagtgaggagcaagccatgcaaacatctggggagacagcatccaggcagtgggaatggcaggtgcaaaggtcctgaggtaggaggatttctgtgtgcttaaggaggtaggttggtgggcctggcaacatgggcagtggcctgattactagggctttataggtgatggtaagggtttgggttaaatgaagaaacagggattgtgagtctaacatctcctcgcttctccttcccccacttccaaacaaatattggtatttttaacataatggccaacaagtttgtgctctattgatttttaaaattagataagctagttcttatctacggactcactttgtctatgggccaaatgtcctgtggttatttgtaaagtataatctggagatattgattctgtttttgcaattacccattagaagaaattgtgttaatctttccctttccttctcctcccttctaaattctgttaggtgtgtgcttcggtacttaataaacaagcctgattacttacatggaaagaactagaataagctttttttttttttttttttttgagatcgagtctcactctgttgcctcctgagtagctgggactatgaaactgcaagcacccaccaccacgctaatttttgtatttttagtagagatggggtttcactatgttggccaagctggtctcaaactcctgaccccaggtgatctccctgactcggcctcccaaagtgctgggattacaggcttgagccactgtgcccagcctagcataaactttttcgttccagagagtaagggattgttgagaagagtgtgagagaaaatccaccctagaagagggcttttgaagtcaaacacaatctctggaattaaaaactcacctttgaaaaagaagcttagaagtgaagccacttaggagaaaataggtgacatgattggcttctattctgctttttgctaaattttctcaggtcaccaaaagttgtcctcaggcagaaggtaacgacatctggaggcaaggacagcgcacgttggccagggacctagttgcagagagatttctgaaatcttattcactctaccaaggcccccagaagaacagatgacccatttaacatggagtttaagggaggaagagcccatgaataaattctgccatagatgccacataacaacctcaactcaggaaatgaagcatgtcatttcatgaggcaatgaggtgtggaaatcaaaggtatgggccttagaactagtcagggatgggtttgaatcctgtgctatctgctctgccacttggcgggtctggggcctcgggcaaggtacttaatgtcgctgagcttctgttttctcttttgcaaaatggagctaataacagaaccttttcccttgaaattggggctgattaagttgcatagagagaggttagcagggtgggtgtacacagtaaacagattgtaaattgatatgtggaaacaattgttgctatctggactataaaataatctgtttcattagcagagccagaacctgcttagaggtgtcaaggatgctaagaagcagtcatcctgcattatttgcacaatgagcatagacttttggtactggtgtaggaatctggaaagagcagtttattggctagcattctctaaggttcttggtttacaaggctgagagaggaaatttctgggcttctggaatggctgcaatgattcagagaaaagtggagaaggtggaggcaccttaggcagaaagaagtaacaagcaaaatgaattttaaaagcaacctaaagctcaggaagatgtgtccccatggctgttccctgaggcttctttctctcctctgaggctgctgtagattattgttctctactaactgcatctcacagcatacacccctttctttcctcctcttctacctctcagccttgtcccttcacatgcacctctaccccttccttattttctactctctctcctcttatctctctcttcctttctctttctgactctgtcttggatctggcagggcctcctcaggcactagtcactggcagtacacagagaaaagtgatttcttaaccaagtacagcatgaacttggactctcccaaaagggctggcagtgatacagaggggcagattccaccctcagattcaagactatgctgagatgagtacatgcaatgaccctgacctgagaactggcaacatctctcaaatccagagtcaaccagaataactgttacccatcccctgtatgccttctagcctccctctgagtcctaacctccctgtatcattcccagagctgccaggacaagatgcgtgctagatctctgcccccacttcctccaaatacaaccctcactacatcaaaacaacaacaacaacaacaacaacaaaacacatttcaaactggtgggactttgagccagattccaatcccttgaaacatttcctggaacacatacccaaacaagcatgaccaccttcttccatgaattctttcctcaaatatagaaatattcctcaagcctaaaatgctattctttactaactaggctacccagaccctgtctatccattaaaacggggcttctattgtttaccatcatatctaggaacagacattgtgaggttggggcagaagctttatggtgttatctgagacccacgtttcttctctcttttttctctcctgccattaacatgttgcctcatggtctaagataactgctggggttctagccatttcatccctattccaagtagcgggaaggaaggaaaggagaatgcatgccaggatagacaacctacagtttctgccaccaataacttctgtgtttttctttatttttcatctattcagatgcccaagtctatgagaaattccttccttcttggtatctcataccaaatcatacatagcatgttccagtcattcatttcattaattaacacttattacatcctgtgatatttccccaccaccaagctcagtgtttggcataaagaagaacagcagaagatggcttctttcaggatcgagatagtcttgtacacacacaaataattatgatacagtgtaaaaagtgtcataaaagaagaggtgaagacatcagccatgggaacaaagaggaggatggttactttgagatgcaaaagggtattttaggtggcagaactctccatagagaacacttgagcagggtggtgaatgacatacaaaattctgccaagaagagaggaaggattttcaggacagagggaaccttgcatgcaaatgcagtgaaggtgaaagtccaacgcaccccctggactgtccagttcatccgtgtggcctgagttcgaatttcttcttgtattccggaaatagttggttattaattcacctaagatccactcagtgtactcatttaaaaagcacattttctggttccctctaccagaaatcctgattccatagcggtttcattttaacaagcatctccatgattcaggaattcccagaatggcagtttggcagccaggagccatgttaaatttaggcatatacatgagacgatcaggcttgggttttacagcagtcactctggtcgtggtgcagaggacgatattgcgggtaccaagagtggaggcagggagaactctcaggcaggtcttataatcattcagacaataggtgatatgggctcatgggcagtgacagtagaagagaaaggagtttagaggaacattggaagcccaagtggaagaacttggtgacactgattgtggtggattggaaaaaaaaaagttgaaaatagctcaggttttttagcttaggtgacctagcagatactgaggccattaaaaggttaaggaaaagaagggaaggagtaagtaagtttggaaaataaaataaagagttccatttgagagccaattaagttgaagatacctgagaggcaccccatattttttcttatcacatacacacacacaaacagacacacatgcaccaatctttctatattgcggactcttctagggcacagatctgaccttggcaattggcatatgccacaccttgcctggaatatagcctgttagaattgagggtgaggcagcagccctagaataagcatatgtccactcctcacctactacttcccaggagggaaaattactataatatggtgaaagatgaattcagcttctgaaatggcaaagcaagtcatgcttctatgtgttctatgaatccaaaagaaatgtcaaatttttgtgaaaaaagagaaaacatgatcactttggaaaacataaccaatcttgacattttgatgtcatccttgagaaaaaacagcatgctgttctgctgctatgtgccaggctgctcccatgaacttgcctaagtatgtccttgctgcacagttttgcatcacttagcatacatgttttatcttcccctttgtttatttgattggggccatggctggttatcttttactggaaaccacaattatttgaacaagataaacaaacaagtctttttaaaaattaactatatcaatttctcagaggctattctattccagcaattcccctccctcctttcctttcttatttcatccactcctcccccaagtctgaatgttctactaatgtctttactctcacctgctttaaactttctagaaaaaactggacaggaggtagtgtttctgttagcagaaacaacaattgccttagagaacagcgataattcaggaccaaggacaggagcacaattgtggtggggctcaagattacacataagagtggtggtttgcatatcacagctgttccataaagctgaaatctacttgaaaatatgagtaaaagggctaattaacatgcatttccctcaaattagtgtgatcctaccaatgtgaatttcatattagctctctcaactaactcttattttccctttggtataggtgatagaaaaaaatgtcgatcctgaaacaatgctgttgccttatttgaggaagaagcgtatccttttctttactttgactgtgtatgtgtgtgtgtatttgtataactccaatatcctcattaaatgatatttcaaatatacattagagacactgagacatattccctactatcatggttttatgctcatatttgagaaagtcctatcattttataggcagtgcacaaatgtggccgtcagaagaaccaattttcttctagtctctgtataaaatggggaaactagtaatggaaacttaatagacgttaaaaggacctaactaagcatcctttagaattagagtcacaatatttatactctgtccttaaggactaattattatgcccattaggaaaagagagcacagaagtcacctgaaatgaaagtaaaaggaaaacggaagaactaaacctgaaaatgttatcctagaaaaacttgccaaataaatgccatcaaaggaatgtatttttagcttgctatgcatgaactccagtgggctacccgacggtgaaagacactactgaattatatgcaaaattatgtttcaaagagggtgtgtacatttttccccctggagagagtaaaattaccaaaagagtacataactccaaagcatcaataattatttttcagacacatgaatatgtttctgaaacatgctcatgaaagtcattcaagatctttagacataaaaaaacaatgaacatgactccctgattatccacagtacctatgtataatatttaaagtttggttcactatgagtgacagaaaactccacctcatggtaaacaagatagaaggtaggagtttctttctttctcattgtgttagttcaggttcttcaggatgtggacaccaaaaatgagattaaatgtgccaggattttattaggagaaatgcctgtgggaaaggaagtagggagtgaatcagaggagacttagggagccatttgatcaccgtgtaagtctgaccctggagataaggttgagtggaagggccctagactgctggtcagtctaaggcatgttcttcagaaccactggggatggttgacaaggactccatgtctctccatagcactaagccattggtggagagcagtccatgggaagcatggtcttaatgaaaactggagtgatcagtattaaagtacagcaacagggtcccttggtcagttaccctctgtgttgaagggaggtctgtgaggcatgtttgcatggctatcacactcacataaaggaagcccacaggtaggtggatcagagctggtaaagcagtgtcacaatgttgttgaggaaccaagcagcaccttcctcagcacacagctttctccccaccatcagagatgactaatggaggcccagccctcatatctgaattccagcaaataggaagaagtaatgagcaaagaaagaagcacccctctccttttaaggacactcttctcctggaagtcatacacaacacttataattacatcctagtagccagcattgttaatgaccccacctagctgcagaggagtctgggaaagtctattttttactctgggaagccatgtgtgtggctaaaaatcagtgtttctatttctaaggaattatgagagaacagatattagggaacagatggcagcttttgcgactgaaaggcagagaaatacacaaacatggctaagatgacacaaatattccaagcattatctacaatttaatattttgctttgtgtcatcaaagacagagataaggatgagaataaatgtgcaatgtgttcataccttcaaatactcaagtgcttacacatatagactcttcttttttcagttcagccctatttttggcaacctgacgtccagttgttttcaaagggagaatgcaagatataacacacaaaaggaaatcaagaatttacaagattattatagcttctataatagtaattaagacataaacacattatttgatgaatatgtattgaacttaactaacatttaagagtctgtgatattactgtctcctagtggcagggctattctagaaagagaattacataacacatatgatctttaactatacctcttccagttcgactcacaggaactaagtatggctgtggaggaggaggctgtggtgcttgtacagtgatgatatcacgatacaaccccatcaccaagaggataaggtaccgtgcagcaaagtccagatatggttgaatttttataattttgaactttgttatattccttcatttggtaaatatatattgagtacctaccatgtgaaaagaactggccacttggcgtacaatgatgaacaagacagacatggtcctaggaatatgaatgttttgggaaaaaaatgtagcatcaatgaggataacatacggtcaaagaattccccatcaaagccaggtacagtggcacacatttctagctacttgggaggctgtcaggaggattgcttgagtttgagtccagcctgggcaacacagcaagaccttgtctctaagaaaaaaaaaaatcccctgtcaaaacttgaatggctccctaactccctgtctggggaggaaaggcaaggctgaaattgcagtggaggataatgccatcatcacattcatatattactcttccagcccctaacttatctccttcctcccatctggtgcattctccatacatcagccagagtgacctgctttaattatcatcagatcaagtcattcccgtacttataagcccccaatggcttcccattatgtttaacatctgtttatgtttggtatttatccttcctcacatttgccaagtttcttggatctgtgtgttgatgtcttctggaaacttctcaaggcattatctcttcaaatatttactctgtgccacacactcttccctctgttcttctgggaatccaattatgctaatgttagacgattttacatcatttcacagatcgcacttgaaggctaaggatctgagcactggtgaggtttcagatatctgcctgtgttccacaccaaactacctgctgtctgaactctgagaggttcctccctgctttacggcctggctgtcagctttttagttcatgagggatttctctttgcttacctctctcaccttccatgctttgggagatctgtcgcagccatgttgctctgtctttagcctctagggagtggcgactaccctatgctctgtgaagtctgagtacctagggtttctctcagttctcctgtctctcccccagccttctttgtttaaggaccagtatgcttggaaagtttcttttagctctccttccctgcctattttggggaactacccccggcactcagtgatctctggtggggaagagattgaagataatgcatcccagctttgtatttgaatctgttgttatcagcccacatgcaaccattcaaaatttgttggaagttggtctggtttctccttattcctgtttaaggcaggttccttttcctccttcaatttcaggaagagaataattgtatctcagggatgagagcaactgtatcttctctcttatgaaggggttgtcacatcggagtttagtttatttatttattaagttttgctcataaagtttctttgtgtactcagcatctgatgagctttgaaaatgtgattatgttcctcgtatggtttactttggtttttagaatgggagtggcagtctcttacaactcttaatggcttgtttttaccttctggtctttgtactaaggcaccagtttctccagttctttaatgtttaacttatgcatccatcagcgtgacagtgaggtgttggtgaagtctggctgctctggttgctaatggagacctggcctgccataggtgcatggttacctgtgactagagaatgtcaacccctcattcaagagcaaaaaccatcaaagttgtgacagtttttgataagtggacaccattctggaattagaattaggaggcgtaattttaatcctgcctctgacactctggctgtgaccctgagtaaatcactctgatcctcagattccacttctctaaaatgggcctgtgcctgagctaaggaggaaatgtatgtgtaaaacctgggtacattatacaaaaacctgccacagtggagaagctcagtgaatgcctggcccctttcccactgtatgcgacataatttgtaatttgtgcttttcttttgcattctgaaggcatcacccagccaatgcctgtctgattcccatctgttctctgtatggtgctgccgtcaccacagtagaaggcataggaagcacccacaccagaattcatcctgttcaggtgaggatgtgcctcttccttataggctttctgtgctttagaaacctcatgacattgagtccctgagattaagagagcggagcagcctggggcctgctggctcggccactccaacagatacaacctagctgggaacaagagtgaagcctggcatattgggatatgtgagtgtttctgactaacttgttggaaaaatgcttttggaaggctagaaaaccttttcttctctaagaatgccctgacatttgtgggtttgttttttgtgttctaattcgatgggacctatctatttgacatcttccaaactcataaagaaacaagagccaggtgcagtggctaacacctgtaatcccaacactttgggaggccaaggcaggtggattgcttgagcccaggagtttgagaccagcttaggcaacatggtgaaacatgtctctacaaaagtacaaaaattagtggggtgtggtggtgagcacctatagtcctggctactcgggggtgctgaggtgagagaatcacttgagcctgggaggttgaggctgcagtaaaccatgattgcaccctgtacttcagcctgggtgactgagtgagaccctgttgtaagaaagagaaggagaaaaagagggagagaggagggaggaagggagggaaggaaggaaggaaagaaaagatgaaggaagaaagagaaagaagagccatgtgcattgagggatataattttatttttttttataaagtggaaaacaacatgatcttaaggctgagtgaaaatttcagctaccaaaaagctttgttatatttagagcttgtttggaagacagatgataggagttgtcaataagttttttggcttttctcctaaagaagcaccttgttagagttttagactcaagtaaaaaggcatcttcagacacctgagtctttatgtatatattgcccataagaatgccatttctaggccaggcgtggtagctcatacctataatcccagcactttgggaggcagaggtgggcagatcacgagctcaagagatcaagaccatcctggccaatgtagtgaaaccctgtctctactaaaactacaaaaattagctgggcatggtggtgcatacctgtagtcccaagctactcgggaggctgaagcaggaataatcacttgaacctgggaggtggaggttgcagtgagccaagatcatgccactgcactccagcctggcaacagagcaagactctgtctcaaaaaaaaaaaaagccacttttcctcatttttattgaagttaatgaagatcaaatatgagaaaagatagaaggaaaagataggagcaacatagaaaatgacccaagttcaaattttctagatttgaaggaatcttggattctgtttatttgaaagatcattacccagagggagagaattttgcctggatcattatgacatatcattaactagagggagagaattctgcctggatgcccatgtgagacctggtcatacacaggcatacaataccctttcatttcttcattgatgcggaactcccattgttacaatgttgccagaagacagcttccaaaatcgacttgaaccttagaagttagactccaaagcaaaaatgctagggggagggaaacgtataaaagaaataaaagcattttattttttatttattttttttccacttctcaacttgagtgtaatttggtttatttctctgaaggatttcttttatctcagtaattcacaaccacaactgcacgttgaaaccaaccatgtgggaatctttaaaagatgtatgcccgtgccccattcccagagactctgtcagttggtttgtggtgctgtgtggggcttgaaatcttaacactgtccgggtgattctcaagagtggtaaccactgccttaagtgaagctcaaaagcagataaggcccaacctcacaacaacccagccctggggagggaggtgcctgggatgagaagggctcccaggggcctctgctgcaatcttaacatgcagacaaatcacctggggatcttgctagaatgcaggctctaattcattaggcctgggatggggccccaaattctgcatttctaacctttctgtgcttccaggagaggattgccaagtgtcatggcacccagtgtggcttctgcacacctgggatggtgatgtccatctacacgctgctcaggaaccacccagagcccactctggatcagttaactgatgcccttggtggtaggttatatatgcatgcttttattttttaatttttatttatttatttattttttgagacggaatctcactctgttgcccgggctggagggcggcggcgcaatcttggccccactgtaacctccgcctcccaggttcaagcaattcttgtgcctcagcctcccctcatgcttttacttttaaacgatgatgatgataatgataacagctaatattggatacctttcatgtgccacacacatttaatagtattaaatactatttgaagattatctcatttgatcctcacaaaaaatttataagataggtactattgttatccccatttcataaatggagaaactgaggtttggggagagtgatttgttcaaagttacacccccaataagtggaagaattggtttgttcaaatcaggattcaaaccaacccacacattgcatttggctgatgtatttctgaagtctcttttgtttttataatcattaaaaagccagttattcatcagcccttgggaagagtcctgttatctccacatgctgctccctcaccactctccctactgggtggtgggtgctttcaggaccatattcaacatcagagggctgcgatggttacagcataaagtcagagactgagatcttatggtgaaacttgatacttattgcaaagaactgtctatccaccctagagcgtttttgtcaagttcaggagctcagtgtgtatgtggcggggggggacatcctcatcaacaagattctaaacacgtttttttaagtgataccctctcaagttctgtttctggtgaacttctccatggctccgtttgtctttgtctcaggcctcccgaagacctcatttctctgctagagaacatgagcctaaagctcatatgtacacttactctgcaaaaatgttccaaggaaaaccagaacaaatggatgtagaaaggagagacatcgctcataaactgtcttctgcctgatttccttcagatcttatcatgaatttgatttcatggctgtttatgatgtaaacaagtgataaggggttctcagatttcagggtacttaggtcatacatgggaatttgtgggtaatgaagattcctgggacccacccctagagagtttgactcagtaatattgttttttaaataagacttcagatttaggggtggaggaggaacaccggatcgcactgtgggagaaacgctggcctgatgatttattataaataaataatgtgccctactgctttcacagtttaataactacctttgctgctgtataataactttgatctttctgtcagctgaagcttagagtgcttttttttttttttttttgtcacagtaagtgttaagaatgaggggttttttccttagaaaaagaagtatagcttgctatttgcaacaacgtaaatgaacctggaggacattatgctgagtaaaataagccaggcacagaagaacaaatactacatgagcccacttatatgaggaatctaaagtagtcaaactcacagaagtagagaatagaatggtgattaccagggcctggggaacgggaaaacaaagatgtattcgtcaaaggtaaaaagtttcagttatgcaaaaggagtaagtcctagagatactgtatagcataatgcttatagttaacactgtattgtatactcaaacatttgctgaaagggcagatgttatagtaatcacaaaataaatgaataaataaataaatgatgggagggaagttagaggtaatagatatgtttataacattgaccgtggtgatggtttcatgggtgtaagacttatctccaaattcaccaagttgtacagctttttgcatgtcaataacagctcagtaaaatggattttactttttaaaaaaaaaattagtttggctgaacacagtggctcacgcctgtaatcccaacatttagggaggcctaggtgggtggatcacctgaggtcaggaattttgagaccagactggccaacatggtgaaatcccatctgtactaaaaatacaaaaattagcctgacctggtggtgcacacctgtagtcccagctactcggggggctgaggcaggagaattgcttgaacccggaaggtggaagttgcaatgagctgagactgcaccaccgcacctgcagcctgggcgacagaatgaaaccctgtctcaaaaataaaagtaaaaataagttgtttttaaaataaggcttagctcttgaatgtgactgtagagcaagtttttggtttgaaattattgtgttgtttgagcacctgtcacaagcagaaggcataactttacaggagaaagtacaaatacctgagcttttaaaatctgcctcaagattcttaatgaaatatcccaagttgctgttgaaaagatctgactttgtagattaggtggactaaaatgtcaaacagatctttcctctatgatagggtcctcatttccatcacactcttggtagactgtgcctctatctgggtcacttggctaacagagctgggtttttctccttcaggtaacctgtgccgttgcactggatacaggcccataattgatgcatgcaagactttctgtaaagtaagtggaaaggaccacatgtttgagtatgttttccccagtgaaacgaaatggtaatggttgtcagtgattaggggggcagccatcttactaatacatggctacttcttatctccaggtttctagctgctgtttgttatttgatcttgagcagggcacttaacctcattcattgagcttgccttggtggtcgcataatgaacacctgagcattttgacactggctgtgtgtcattgcttccaagaggtctttcctgacctctttgcctgggtcaggtaccctggcctggtgttcctatagccctctgcgaacatgtgacgggcatacacatgtcccgtcacagctttggtcacaatgtggtgcaactgatcatttgctatcccatgtcttcaccagactgtgggctgcttcacagtagaggctgtatatctccgggtccagtcaccatatagtcattgagtagctactcaatatttgttgaatgaataaatgaacaaacaaagttgaaatgaaggatataagattgccctctggaagttaaacaatgaattcagtatatcatagataagaacagtgatgacaataacaatacctgttaatatttattattaatatttaaaatactaacaatattaacagttaatcattattaatatttactatttaatgctatgtgccacgcttagttataagatctttatgtcttttaacttatttagtaatcactgctattcaaaattttctgtaagctcaggtttttcattaatgttggtttggatatgtttaagtacaaatggctctctttcatggcatctaacgatattgattcagcattatgtttcaactggcattcacctgctttatttactagttagtagaatcagcaataaattcctagtgatttgttttttgtccactagacttcgggctgctgtcaaagtaaagaaaatggggtttgctgtttggatcaaggaatcaatggattgccagaatttgaggaaggaagtaaggtcagtgaaatgtaaagcttttataaggctttctcaggacatgaacaggagccaacatactcttaggaagaacaaatggctacccaagttgactaacttgaggtatgtcaacatgtgccctctcccattctcactccatctctctataaaaaaaaattatatcgcagcaactttgtcctcattccagatattattcccatttaaatacagttatctacaggagggaaaacacattggttccttagtgtctcttagcttttaaaagcattttttcaagttatttttcaagggccagaagtaaagtggagatgtcatgaaaataaaagaacaggtagaacaagtagagacaggagaggttcagggagccgttcttgttccagctgtgtctgcggctgctgcctcctcttctactgtccccagactccaaagagaaggtacagggagttgaggcctccagaggcccattggcatcagcactgagttgctgatgacaaggtttgtgttagagcccttggtttggagcgcggggattgtggctggccagtggacttttttgtcggtttgctgtatctgactgtgtatctatatcttttgaccttattccacaaaggattttaaagttgctcgataacagtaatttctgatatgttctctttttagacaagtccaaaactcttcgcagaagaggagtttctgccattggatccaacccaggaactgatatttcctcctgagctaatggtgagtaaagcaatgttgagctcatcctagaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaagcagcagatagcttctataaaatcgtgaaatcacagtgtttgtaggtatagacatgtttcctactttcacttttgctgaagtttattcctccatagaatgatttaacaagattcagcatgttactatatttgctaacattaaaatgatgttctttgagacaagagcaccaaagggagacagaccaagcagttcccaggagtaaagaaccatcgtgcttttattctgaattctaattccttgtaaagctctacttttaggtcactttgtactttattttttagaagatatgtattttctcattctgtatctacagtgctaatgattgagtggaaacaggtggagatggcatcattgggtaccttgaatccctattgctttttcaatagataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtgggtatgtagaaccccagggattttttatagggaaattgagaaaaagggcttgggatggggccggggtgggctggggaaacttcatatacatgtgttctcaggaaaagcagtctgaaatagcatttttaatcatttgagctagacttcctgagcattgctcaagagactttctaactgttattaagtagattcctcttgcctcttattggagcagtgtcaagagttgtaccgaaggggcttgctccatagcaaaccagcagcaggagcttcagtgacagctgtcctgtctttccttttggggactaatctgggcctcaaatttcaaattgctctttgtttcctctctcagggtgtctcaataggtatatgttttacttaaacaaccgctacagggtcttcctgttgcatccagtgtgtgctcagcttgaggagcagcccctagagtcttcccagagagaattttgaacatgccatatggcccaagtttcaaggttgacaattccagagtcttccaagtttgatgaaaatctatccagccattctctctgtatgtgatttggcaataaacagatgaatagaaagatacaatatttttagatatttaaagatattagtttaataataatttcaaatttaaaaggcagttagttcctttattctagtcttattgatttttttttttttttgatcctttagggcctgaagtgaaatttaaaggcgtctttcacccagttataatttctcctgatagaattgaagaactgagtgttgtaaaccatgcatataatggtgagttctcaagtccctgttttcttagttaagatgcattaatcaatttatttaccttgcccagcagacaagcagaaaaagaatgattcctaattataatacacacagagattctcttcttataagaatgatatgtttgttggccacataaatgtcttcttttgaggagtgtctgttcatatcctttgcccattttttgatggggttgctttttccttataaatttatttaagttccttgcagattctggatattagacctttgtcagtgggtagattgcaaaacttttctcgcattctgtaggttgcctgttcactctgacactaatttcttttgctaggcataaactctttagtttaattagatcccatttgtcaattttggcttttgctgcaattgcttttagtgttttagtcatgaagtctttgcccatgcctatgtcctgaatggtattgcctaggttttcttttagggtatttatggttttgggttttacatttaagtcttcaatccatcttgagttaatttttgtataaggtgtaaggaaggggtccaatttcgttttctgcatatggctagccagttttcccagcaccatttattaaatagggaattctttccccattgcttgtttttgtcaagtttgtcaaagatcagatggttgtggatgtgtggttttatttctaaggtctctgttctgttccactggtctatatatctgttttggtgccagtaccatgctgttttggttactgtagtcttgtagtatagtttgaagtcagatagtgtgacgcctccagctttgttctttttgcttaggattgtcttggctatacaggctctttttggttccttatgaaatttaaagtagtttttctaattctgtgaagaaagtcaatggtagcttgatggggatagcattgaatctgtaaattactttgggcagtatggccattttcatggtattgattcttcctatccatgagcatggaatgtttctccatttgtttgtgtcctctcttatttccttaagcagtggttggtagttcttcctgaagaggtccttaacatcccttgtaaattgtattcctaggtattttcttctctttgtagcaattgtgaatgggagttcattcatgatttggctctctgcttgtctattgttggtgtattggaatgcttgtgatttttgcacattgattttgtatcctgagactttgctgaatttgcatatcagcttaaggagtttttgggctgagacgatggggttttctaagtacacaatcatgtcatctgcaaacagaggcaatttgactccctgtcttcctatttgaatacctgtatttctttctcttgcctgattgcactgggcataacttccaatactacgttgaatagtagtggtgagagagggcatccttatcttgtgccagttttcaaagggaatccttccagcttttgcccattcagtatgatattggctataggtttgtcacaaatagctcttattattttgagatatgatccatcaatacctagtttattgaaagtttttaacatgaggagatgttgaattttatcaaaggccttttctgcatctatagagataatcatgtggttttcgtcactggttctgtttatgtgagggattacatttattgatttgcatatattgaaccagccttgcatccctgggatgaagccaacttgatcgtggtggataagcttttcgatgtgctgctcatcatcactgatcattagggaaatgcaaatcaaaaccacactgagataccatctcatgccagtcagaatggtgattattaaaaagtcaggaaacaataaatgctggcaaggctgtggagaaatagtaatgcttttacactgttggtaggggtgtaaattaattcaaccgttgtggaagacagtgtggtgattcctcagggatctagaaccagaaataccatttgacccagtaatcccattactgagtatatacccaaaggattataaatcattccactataaagacacatgcacacttaggtatattgcagcactatttacaatagcaaagacttggaaccaacccaaatgcacatcaatgatagactggataaagaaactgtgacagatacacaccatggaatactatgcagccataaaaaagaatgagatcatgtcctttgcagggacatggatgaagctggaagccatcattctcagcaaactaacacaggaacagaaaaccaaacaccacatgctcttactcataagtgggagttgaacaatgagaacacatggacacaggaaggggaacaacacataccggggcctgttggcgggtggggagcaagggaagggagagcattaggacaaatacctaatgcatgcaaggcttaaaacctagatgacaggttgataggtgcagcaaaccaccatagcacatgtatacctatgtaacaaacctgcacattctgtacatgtatcctagaacttaaagtaaaataaaagaaaaagaaaatggggacagaaagcataaaaaaaaagaatgataacattctggaggaagactgagggaagaattctctaaagttaatctaaatactaattgtctgaatagttcagtttttactgaagaacttcttctgtctgcaatatcagagaaatgtaacaactattcaatgaaggatacggtgctaagtgctggacagaagataaagatgaatataacacagtctttgctctttaaaaccacagtagcgagtttatgtattcaacagcttacagactggtttttctactcctgtagaggaaattgatataatggcaatgataagaagcaatagaaatgtgggtttgcagtacagcctctgaaatctaactcttgacaatggcatatattagctgtcagatcttaggcaagttactcaactctcagtttcttcatctgtgaaatggggctattaatatctcataggtatgttcagatttaaggagattatctaaagcattcaacataatactcaatagagtgagtgttcaaagaattcagccttcattacctccatcaacaccacttacatcactaccaccacctctatcattaccccaccttcatcaccaccaccacaccaccccctcaactgctatccctaccaccatcgcctcaccaccactttcattactaccattaccttcatcaccatcaccaccatcactgcccatcaccaccatcaccaataagcagggcagcatgtatccagtataaagattctatgtctgtagctttggtctaatggacattttcagatcagcagtgatcgcactgtgttatttacaaatgacttcatttcaggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggctgtatgtatctgatgacagtaaactctggtatgcatcccttgggtgactctccctgatgaatcatgacattttcattcttttggaacagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaaggtaagtgacagcccctacttggagattattaagctgtttctctacccctttttctctctggggaggcaggaaatccagtcttgaaaatgacttttccctataatatcaatacatttctctgcttttctggatactggaaattttgtgagtcttgtcttaatagcacaggctttcttcccctgtgtctttctggttttttgtttgtttgtttgtttttcctcatactggtcaccctacactggacatgtttgtgttggttaatgtccggatgtgatctgattattgctgggaactacatactattgagaactattgggtccctttgttgaagacattctccaggtggtacaggagtgttgtggcacccacatcgtgctttgagctcacacttaatttatcattgatggaaacatacaggtctttttcaggtgaaaaatgattgggcctcattctatatttatttacttgatttttgttattaaaactaagtccacaacatctaatttatcgcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatctttttttttttttgaaatggagtctcgctctgtcacccagtctggagtgcagtggcacaatctcagctcactgcaacctctacctcctgggttcaagcgattctcctgccttggcctcctgagtagctaggactgcaggcatgtgccaccatgcccagctaatttttgtatttttaatagagatgtggtttcactatgttggccaggctggtctcgaactcctgacctcgggtgatccacccgcctctgcctcccaaagtgttgggattacaggcatgagccacagtgcttggtcacaaaactatcttaaagaggaagatttgcattcagggttttcaatttgagtaacatcccctaaaagtcatactatgagaaacaggtttgtgatgtgaatatagacatcaaaagcttcttagctttcagtattttgttatagttttaaactgttcctcttccttatatattaattaaagaactaaaattcttcaggtgttggaacaagatataaaaaagtaagataacatctcagtagtatacaaatttattaaagataatttcttattcatgactgtatctagtggggttcctggttataaacaataaatatttgttggctgacttgatcagaatatcaaaagagatattaatatttactccctacttgtaaagttttaagtgaattgtgttgtcaggaagaggactgctaaggttctattctacctgaaactctgggctactctgtgagatcttttcatctattttttaaatctattttttatttttaaaaaaattttttagatggagtctcactttgtcatccaggctggagtgcagtggcatgatctcagctcactgcaacctctccctcccgggttcaagtgattttcctgcctcagcttcctgagtagctgggactacaggtgcgcacaaccatgcccagctaatttttttgtatttttagcagagagaggtttcaccatgttggccaggccggtctcaaactcctaacctcaaatgatccacctgccttggcctcccaaaacactaggattacaggtgtgaaccaccacgcccagtcgatgtttttatcgatgagaaagcaaggaaaacaaaaagagatggggcctagactagaagaaacattgcaagacgcattatagggtaaaagatttgcgaagcataggaagagcacctgtttccctgaacaaccggtttcctcaggtatttggtagaattacttcctaagttttggaagtttatttaacagaccaaacagatcccagggaaagtgtcatttctttccacagaaggaaaacgacagattcctttaaatgagcaattcctcagcaagtgccctaatgcagatcttaagcctcaagaaatcttggtctcagtgaacatcccctactcaaggaaggtgagaacatcccactgtcaatttcccagttgcacctgtgatgctatggcttgtttattccagtatatggtggaataagaaaaagggtgaagtgtttatgtgggagataaaggctcaacttcaggaagtggtatgaggtcattattttaagacttgtgaatagttgccttttccttgtattacgcatgcccctatcattcctcgaattaggagatttttttttttttttgagatcgagtctcgctcttttgcccacactggagtgcagtggcatgatctgggctcactgcaatctctgcctcccaggttcaagcgatcctcctgcctcagcctcccgagtagctgggattacaggtgcgcaccaccatgcccagctaatttttgcatttttagtagagacggggtttcgccaagttggccaagctggtctggaattcctgacctcaggtgattcacctgcctcggcctcccaaagtactgggattacaggtgtgagccaccactcccagacttatctctgccattctcgctctttctccccctaccccaagctctaaagtaactttctaaaaggtttttgtcccataagcctttctccctaaatatgacatgaagagtatgcctctacctatatcttgggttttgaaaaaagcctaaaaatacatttgcaatagaacttattggaaaaaacatgaggctttgcatgagatagagtcaggtttgaatcctggtttcaaggcctgaactaattactgaatccttctgcgccttggattcctcatctgtaaaatgggaataatcaagcctgcctcagaggatgtattagtttgctagggctaccataacaaagaaccacacactgggtggcctcaacaacggagaatgattttctggagatgctgggggctgcatatctgatatcaatgtgatactcaacatacacataccgtccagcacgtaggtgatgctcaacacacacacactacctggtgtgtaggtgacactcaacacacacagactgcccggtgtgtaggtgatactcaagacacacagactgcccagtgcataggtgatgctcagtgtttctacatgtgccacttaactgtttctttcagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggtaaggcattagaagtaagggctcctctaatacttgtccttagactccaagtattagaggagccctttttgtggtgagatgtgattacaagaagaaaagtgttccatacctttctatttaatggctgggaattccaataagattttgttattatttccatatgtcttgatgttagtgaattctgaagtgggaattatatactctgtgtgcgtgtgtgtgtgtgtgtgtgtgtgtgagagagagagagagagacagacagacagagaagccctccctcaacagtgcaaatttgtattctttattttgggagaataatttgccatgatgaaaaaccaattatgtgagtttgttctataataaattgttaaaggcatttgcttacctgacttcctatatctaaagatgacactaatagctaatatttcttgagcattacttggtatcagctgccataacaaagcatagtgattaaaagcatgagctttaaaacttgagaaaggcagactggccaaaatctcagtttaccctctgttaactcctccatgctctcagtcagcttacttaattatattggtactttggttccctagctgtcaaagatgggtgatcatacctacctcacagggcagttgagaggattaaatgagtgaatacatataaggtgctaaaagcagatcttggcatgcaataaatgtcctagtgaggacatttattagtgagtaaatgagggtcagttactcctggactgtggattttatatgagttgtcatttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataaaaaagacaatccacattagaaacacacgtacttgctgaacatccctcagcctgtctgtgggtgggtatgagtttagggaagaattgaaagtagagccaagagttgatcaggcttttatttaacaccactcaattatttggtttctgactgttagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccataaggtggccatgatggcagccactgcacaagatgactgtgaaatgcgtcattgtaggaaaagggcttcatatggtccctagtgcttcagaggaaatctgtagtagtagtcataataatagtagtgacaatccatgcattcttttgcctggtctctcttagggcaaacaattaaagctacaagattcttggctggggaggacacaactaaaaaaaattctctgaataaatccattagacccaaaggagacttgagcctcattggcctcacaaaccccatgctataaccagctgaccaaaacagactggaagccaagaacagtcttcctgtggtatagaagttagtatggtcactttaaatagcagacacaaagtcctctcttatccttgcttttgagggtatcttctcagtgtaggtgggagcaactaggaaccagaagggtagtatcacattattaagaatgaaaatttgaaatcatagataagtgacatattgtcaccaggtaaccaattatagactcctccaattagtagcaaactaatataatttctgggtgactcaagcgatgtaatttaaaacttttgccttgtagtcttatacccctcctctctttaaaaataatagcttttgttggttttatttaatttttttttttgagacagggtctctgtcacccatgctggaatacagtggtgtgatatcatagctcagtgcagcctcaacttcctggactcaagcaattctcccacctcagcctcccaaatagctgagaccacaggcatgcaccaccatgcccagctaatttctttatttttttggagagacagagtcttaccatgttgctcaagctggtcttgaactcctggactcaagcaatcctgctgccttggcttcccaaaatgctggaattacaggcatgagccatgacacctagctggttttattttctattaaaattatgtaaattagaaaaaataaccaccatgtgtattgttgaaagcctttccccccatccagctctaggctgtgcaatgttcagtcttgtgtaaagaaccaaatgactcacttccctcagtcctgaggaatgttcttgctggggaccagaatccttcccctgtagggcagcgacagggatgcagcctgtgtccccctttctacacagctggcaggcaacatggaacctttatgcttatttgcaatggtgtactttgactctgatgttttcctggcttaagtattttcttcctttctattttatttacttagcttctatcttcttgttggatcagtttgtaagtcctcatatcatttaggagagtatatgagagaatcataagaaacatagagctggtggaagccagttacctaccgtattcatctggctattcataatatgaggaaatatgtatgcacctttcagagtatatgtccttgagtcagggagctgcttgtatttctggggttctgaatagggtgagtgcttaatatacgtgagacttcagagtagagatgcttgctaagactcatgctagcctcacttccaaaatcattctggtgcattcaaactatttaaaatatctgcaatggttctacttttcaggatccagttcactatcctagccttgcagacaagtatgaaagtgctttagaagatcttcattccaaacatcactgcagtacattaaagtaccaggtgagcggtatttcttgtttttaaaaattcacaatctgggctatagtgatttgacctggacattcccactgtctctccgtgaaactcaagctctgtaagtccaagctccacttctggtaaactcacagcctctttatgggtaactaaaattccaaaatcaatgaagaatttgattaaagacaaatctagcagtggtaatattaaagaagaatgttgatttgggtcttaaaggttacgtgctttgcactgtggccttgtaccacagacacgcatgagatggccaccttgtcacgtgttttctgccctgggcactgcaggcatcagagtccaataaagccacgctctgcggcaaggccatgggctgctttgctttcattttcagaggaaaagacacagcccctagaggttgatgaaaattcaataatgcttttaaaaagaactgctgatttgtttagcttgaatgttaagatattttactcccttagtctctattcttctagtgatttttctgtgagttacattttagagttgaatcaaacgtaagtactaagagctttttgtgctctcgtaatgaaggctattagaaaacaggattcctaactctcaaatggaattttctgccacatcataaaaatatgcctgaagtcaccctgttggtaaagtggatacagtttggtgggtttttccttgaaattattatcaggaaacttgacctcgagagttttagtaagtcaagaacatgaaaaggctttttaaagcatttgttcactgaaactattgttggatttggttgtgaaagcttatagtatgtcgtaatgaacattgacgttggtgtgtattccttgaggttttaggttcaatatgtttaaaaattaaaatgcaccaaactccattgaaaatgattgttttgaaagttaaaaacagctgccatctccccggtgttcttttcaaatatgatagttgaaccctttggcttataaataccctaatatttcttagacaatggaataaacttcagaaagaaacaacaacaaattaatggatattgaaatcatccaaagaaaaaggaaaatcttcacatagtgcatgatcttgaatgagagtttatcattgattgcaaaacaaagttttagatgcaatatgtctgccacatagatgagttttgtttttgttttgcccgtggtttttcacacacacatacaaacatccacattgctagagcaacgtcagcactcacgaagagcatttttcccctaaatcagttcatttgctttgaaaatattttgacacagcttcaaaagatcaccagtttgaggagacagcattcttccttccatagtatctttagccaaatactaagcagaagcaggtaattgaggacagcttctttcaccagtagatttatcacaactaactgcaaaaaaaaaaaaaaaaaaaaaaaaatgtatgatatctttgacggtaggacaaagacattttttggaatttttcctcagttttttggcaggcctcacacaacatggtttcaaaagactttttttcaatgtgatgaagtgttttgtttgttacagtgaaatgtgttatgtcagttaactcccagacccattacagatacctatgaatgtctttccttaatgtctgagcttatgaattatctggaattttgcttttcaggatgaaaaaacttcttagggttttaaaaagaagatgtgggtgattttttttcactcaaatgtggttcaggttgagagcccaagcagcatcacagctcagcactttgggggatattttgcagaggaagtcaattcctaccatctgcaacatatgaaaaaccacacctggtagaacctcattgttggtttttccttttcatcactatctcagctcctcgaagcagagggggaagaggagaactgaggggattcctttgccatggggacagggcagtgtgagctacgtcaatagagctggagtgttgggactgtctccaatctgtgctcatgcctgaaccccaataagtaaacttttctctcattttccctagtcccctacattcgtggcctaatatctacctttattgaatggagccctgggccaaggtctaaattatttttctcgatagtctcctgctttctagctgataaagtcaggatgactcaacaataactgaaaatgaaaaaacaaaaacttagtcaatactccgttttttgttcactgtattatactaactacaaaactgaagtttacatttaagtaaaagaaatatgaaattagaacaataaatgcttatcaacagtgtttattttgcagcaaaacagtaaattttatataaaataggaataaatgcatcctacacacatgtcttataccaagttaattgtagaaattacactactttctgtgcatagttgtcagccacaatttggttgacattttacttcttgtcatttatgttatgaaaataatatggtttttttattttcaaatcaatgttgaacatgttctgaaataacacatgccactctgccgttctctcctgatattccagccctgccacctgcctggagaatctctgatctctatctccagccagaggttttttgtttttttgaggcccttaagtagttgggtagtgagtggggagcactcttctcgagttcctggagcagcagagggcactggagaactgtacatttcacagctgtcttaagtaaagctctcattataaccagaggtctcctccatttgtgggattagatgaattaaatccaaatgttcagaaaggaaagcaaaacatctgcatgaaaaggaaatgtgttaatcggggggatccagacagcttgtcttcagttccatagagcaagagccttggagcactttcactggaccagggcagactttgaaacaggaaaccctgcagtgaagagtgagatgaaataccattttagatggattcaagtatctaacttattgttcatatgtgctgaataggctttctcaaactgcacattctggtaatcaaatacaaaagaatttagcttttctccccgctcagatgccttaaaggatgctatgttggaaataggcctgtttcttcttttttctcccagtaaagatttttaaccagtatgtgttggcgacttgttctctcttccctcctgccatatgatgtgtagcctggcattgtaaggctcatctaaaaggaagatccagggctcagggtgatcctgtgagctgcaggatgggaaggggaggtgtccatagcttttctctgacctcaacctggccaacatgactgcatgcccctcacccccaggtcttccagagaaagcctctgggagtctggcctcagtcccagtaccgagtgcaatgttgacacagtgagttacagatgggggtacccaccagggcttagcaggccactcctcagccacagccttcaccctggccttatgtctgtctcttcacctgctctccttctttcttcatatcttcagttcttttcacaatacacacccgactgggaaagccataaattcccatatttgaaacaccagggcagacattgtgctgattaatgtctgctttgattaatgaaacacatttaaggtatttacagagccaacagcaagatattctgctccatggggctctaagaaagagcaacattagtggatcattactccaattgcaggtccctttggcttcattctctatcaggattgtctaagttaagagttttgccaattatttcttatatttcctcactcaaaattgaaaaaaagaaggctattctggttgaagtaataccctcagtattttctacaaacatagtcacgatatcatcatactcttctgtaaaatattatatgtatcgtgcttatatagaaacagtaaagtcattttgataataaaatttaaagagatacataagcattagcaagaggacataattttgtattgtcaagaagaaagatttaaatttgtttacttacacaaatggaatttccatttgagatgtttggggtctacattcaaaaaaagtgaaaaataagaacaacatcatggattgacataccagttggcttattgaattactgtagtaggtttattgtcttggtgttattaatagtgactttttttttttttttttttgatggcgtcttgctctgtctcccaggccggggtgcagtgctgtgatcttggctcgctgcaacctctgcctcccaggttccagcgattctgtagcctcagcctcccgagtagctgggattacaggcatgtgccaccgtacctggctattttgttttgttttgtttttttttagtagagacggggttttactatgttggccaggctggtctcgaactcctgacctcaagtgatctgcccaccttagcctcccaaagtgctgggattataggcatgagccactgtgcccagcccaatagtgctttttcatatgcaaaagtattctggtttgagtctaaattatatagctaccttcttatgggaaatgtgcataataataattcctactttctctatagaaatgtaaaagtatattttggttatttattaaacagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtaagtggtaaaattcttactcaatgggcataaatgattgtcttttcatctaagtcacactagtgaaaagtaatggtgtgaagaaataggctatttgttggtgatatccaatgcagaccagaggtgaaacaggatcgaaatgtaggatttactacaacttcgttgtcccaagaattttttcccaattgtctggcagagactgttggacagttcttacctctctcatatcttattatccaattaaccatgttcttggcctctatggccactctaaggagctctgctgtgtatatcatctaggtctattgatctgtcagaagctctcagcatgcccggtgtggtggacatcatgacagcagaacatcttagtgacgtcaactccttctgcttttttactgaagctgagaaatttctggcgacagataaggtactgcatttttgctttctatttgaaaaataactttctcagttaacggtgcttcatattttcttaaagataccatctactttggcacaccatgaaagactccagtattcttagaatgcttattataaaagtatattctaatattgaatgaattcaaatatattcattttctgtacaagtaaagacattaactagttatataaaagattatttggtgttttacattttctaatagtgagatggcatactgctaatggtataaatgagtaaatgaagatggaataatggtaaattttatatggaaatcccttccctgagaagcccttattattgtcccagtctcagtgtggtcaaagttcaactacaagttcaagtggtatctgcaccatgaagccttttttctcattcttcaatccagaagttcattcattctctctctctctctctctcaatttattctgatttatttatatttccatgtgttaaatgcgctttttattttttattttattttattttattttgaaatggagtttctgtttgtcacccaggctggagtgcagtggcatgatcttggctcactgcaacatccacctcctgggttcaagcgattctcctgcctcagcttcctgagtagctgggattacaggcacaaatcaccatgctcggctaatttttgtgtttttagtagacagcatttttgccatgttggccaggctggtctcgaactccttacctcaggtgatctgcccgcctgggcctcccaaagtgctgggattgcaggcatgagccaccacgcccggcttaaatgggatttttaaaagtgagcatctatgatgtctggtcaccatagctgaacaagatatgtatgatctctactctcatggagcttaaagtctagaggagaaaacaaagtgacctttatgtactttctaccttgtgttaagcttgtttattttgatgtcttatatatttcttccacctagtataaattccttgagtgaggacccatgtctgattcatctgtgtattccacacactgcttctcacattgcagggtgaatgagtagaggtatagtgataacattgttgccttgtgaaaattacaaatgattaaaactttggctacagcaagaacagcagtcaacaggttttctgcataattcggactgctcagttcagtgtttacccaaaagggcttcataatttgaaacagtcccttcctctggctctccttggaagatactcccttgaagatattatctgtagaaatgaaagcttgatgactgagagtttgaactcaaggttgaaactcccccaaagcagggctgtgtagcactggcagagacggtgagaatttaagccctttgcataaatgtttactaaacaagtgaaactgatcttggctgcatgatagtacctgctctttgaggtgtgcttatgaagatcataagcatctcaggggccacatctatgtgccaggtcacaggagcaaaatcaggagtctttggagtgccattgtgaatgattgcctttgttggtttaatgctttttaaaacattcatttatggcacttaatggcttttaaaagtcttttcattgtagaaattgtaagcatacacaaaaatgggaaagtattatacaatgaaccccatagatccatcacccagcttcaacagttatcaacacgttaccattcttgtttcatttttctctccttcactgcccctaccccaaacaaacacactttttttgtgttcatgctagattttatgtttttaatgcctttttttcgatgataaaactactttatgttcattgtggaaaagacataatagttcaaagtcaatttttaaaatgagtgattacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagcctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgttatcacaggggactccccttcccaggtcatcccctttttctctctggttgagatgatctgtgacttcctggtcctccctgtccgtgcaggcagaggctgcctctctcagaacagctctgattgtcgtgtgacagccaaacatcaagccatgggacaggctggccctcacacagcctcataggcttggcctggagcctgagcctgctgtcctcaagacagcatcactcctgctcctctgatacagcacaaggatctaaacttcccccagtgcctcggatcaggaggccagctgtggttatagtcatggacagatgtggaggggtcacacctgtgtgtatctagccctagccctactgtaatcgagtactaggagggaggaagaaaatgaataaaagagaggacctgatgcctgccctccttgacaacaaaggtctttctgtgtcgtaggtgttctgtgtgggtcagcttgtctgtgctgtgcttgccgattctgaggttcaggcaaagcgagctgctaagcgagtgaagattgtctatcaagacttggagccgctgatactaacaattgaggtaatgagttctgtggaatggtggtgccagttgggagccagaacaaatatcagttaaaatgcttttggctactgtaacaggaaaatgtggctcaaagtggcctccaaagcacacggactttattaacctctaaccagtctcagtattaacaatttccccaaggacatggcttctttttgccactcttctctgctgcccacaatacaagctcaattcctgtggtcacacagatggccgccaggacaacctggacttccttgttcatgttcaaggagtaagaggaaccctattgccccagcattctaagcacaaatcctgagatccagcctaattaagccacttaggtcacatatccatctccaaattaatgactggcagaggaatggaggagctgttggttacttctaggggtaggagttggggtcaggtttctctgaagtaagtgggctatgtaggggagtgtaggaaactgaaacaaatctgagccctgtttggaaagggaaaggggaggggatgctagatgggaaacagtgatgtccaggaaagtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaatttataaaggctataagactcatctccatgaaatgataggatgttctcttgtgtgcattccattggttcttataatttcctggatgatgaaagaatgaacactggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaatttttcttacattttaaaataaaaataaaatcatgtcaaatagacaaaaacgtagaagtctaattggagtcgaagtgtgattaggcctcccaaattttcctggccagtttcaaattcaaacactctgttcccttctcaggcccttttcatttacatgttgcatgctgctcttgcttcatatattctgtcccctgaagtttgctggagagttagaattacttattagaaattatttacgtaacacttcatcaatattttgtttataaatctttgcccaatatcaggggctaaatatctactctccactccccctaccttccagccaaataaaagccccaataagcaaatataatagatgccactccccccaccctcaccacttcaaccagcagactcgtgattgtctgccagagaatcccagcatcagatacaagctctggctttgtggaaaagagttgcctcacattgtgttcagagattaagctctcaaagtctaaagatcatcaactggatcagagcaaatttaatcaaagtttagagcagggaaatatgcccctctccctatacattacagttcttttatcactttcctgactaagaaaaattcagaaaattggctcaaagttattcaaagagcaagcagccagtgaagttgaaaaagatgaaacttttaaaaataggatttataaaacctagcttttttttcaacctggaatctctttaatcttagattaataagaaaagcacatgaacagattccaataggaagtgtgttatcaatcaaaatagaacaaaaacaaatatatctctgtcactatcacaaagatttaatctggcacatgcttttcgagtttttagtagattgaatggggcaacgatcaaaactcttgaatcaaggggtaaggctgatgaccataatggaaaaaaatgtgttccctaccggaatctgtcctgaataataatcatcaacaacaacatgagcatagctaggacctatacagagctcactgtgtggtcaacatggttctaggtcagtttcacacattaacttactaaatgctcaccacaatcctatgaggcaaaaactatttttatccccattctgatggggaaactaaaaggcagggttacccaaggttacatagctagtcagtaacaaaaacaatcaacaaacactctgtcaaagaacctgggccccaccggtgctataaacaaaccaacccagtttttgaatgggggaaatggcagaatcacaatagcccatccctctaaggggtgttgtctagacacctactggtggccagaaggaaacagagataagagaatccccaactaccaacagaatggaatttcatggatggacaataacccacagtagataatgccagcaggagctggcacaccacatttgccagtggacacatggattactgcaagataaattctcagggatagctaaaaaccaacctatgttattgtaactacatctctggttttgtgcaccactgtacccttttactgggcacccagggagagccaataggagctagtgtataaatggatttgtacacccagctcccagacagggcttgtctgaaatcttacttccagagctggaggtcccaggtgctctactgccctgtgcaaatgaaatgctcatccccacaaagaaggaatatggggctggcaggcagagccaccatgatcccaatcactagagtcttttcaactagcaattattgagtgtttactatatgcaatataagctcttcacgtcttatttcattttatcttcaccaaccacgatcctattggagctatatgcacacctgttacttccattttacagacaatgataagagaggtgaagtgataggcccacagtcaaagctggtaagtgggaaaaatgtgtgcacaatgctgactgggtctagagcccaggctctgaagccctgtgctgtatggccttggctacatgaaatggattgtggtgtgcagacaataacctgcctggaaaatactagtttcattctgggatcacttagatgccagtttttttctgtgcatattatttcttcagactcagtaggcacatttacatttcctcactggggagtctctctgcagttggattcttagcttggctcaccagggtcatggtgaaagtgcacggaaccacaaggtgaagggagaaacaacccctgctcagaggatgtgcagtggggtgtgtctgctgccctagggcagggtctcttgcccaagctgcctcattcctctgttctctttctaggaaagtatacaacacaactcctccttcaagccagaaaggaaactggaatatggaaatgttgacgaagcatttaaagtggttgatcaaattcttgaaggtaaaaagtaatggaagagtaaacaaccctggaagtcttctaagcatgtcagtttaaggcttcctttgtcttctggaaatcatcgggcagcctaggggggtgttgctcctcaggaacaggcagaacaggcacctcattcacaaatgtgtttccctccgtctctggggtaggccaagagccaatggggaggcaaaagaggaggcaagaccctgcccctcttccctgaccccccttccctcatcaaggctccagttgttagagatgtcattttctttcctgttcacaaccaccctgcaagagggtattattatctcaatcttataggctggaaaatggaggctcagcgtaattatggagtgtgaccaaggtcacacaacaactactaaataacagagttggccattgaattgataggctttattaggatttccaaagcccatgtttcttcttcatcctttctctctctgattctccctctcttcctttcttccttctctgctttttcttcccttcctcttcccttccctttctcctttctctttcttccagacttctttgctgtatgtatgtatgtaattaaaattaaatttgcctcttagaaaatagttaattatagctttccagtacaattccttaacttttggctttgagatattttaaaacttacataaaagttgcagaaacattaaagaaactcccaaatatttttcactcagattccccaattatacacacacacatacacacacacacacttctgagccatttgagagtaaattgtaaacatgatgtatgtctctttacccctaaatagtcagcatttgtttcctaaaaacaggatgttgtctaacataaacatagttatcaaaatcagaatattaacacatattctattaatctacacagtttattcaaatttcgctagttgtctcaataatgtcctttatagcagaaaaagaggttcatcataagtcttaaataacccatgctttccccgccacactctgctgtcattgctgctgtgaaagctgtcctaatgcctgcctcacaagatctctgatttacagacatgctattgggtgggtatgggcagtctgtgccacatctcagagcagagaaatcatccggcattatctgtctttaagtgaatttccagggcattggcctctagtgcatgttaaaaactcccatcttctgggctgggcatggtgactcatgcctataatcccagcactttgggaggccgaggtgagtggatcacttgaggccaggaattcaagaccagcctggccaaaatggcaaaaacccctctctactaaaaatacaaaaattccaggcgtggtggtgggagcctgtaatcccagctactgaggaggctgaggcacaagaatcgcttgaaccctggaggcagaggttgcagtgagccgagattgcaccactgcactccagcctgggtgacagaaggagactccatctcaaacaaacaaacaaacaaacaaacaaaaaacacaactcccatcttcttaatttttctcaccaaccttgatcacaagaataggaagagtcctaagacacatcccatcctgagtgcacagccagagctgtgtaatatgtcaccagtcagcccagcttcttaagttccaagcccatcatgtctcaactctataggtgcattaaacttgaagcgtgtcaggggctgactggaaatgtcacctgaaagctgtaggaaagacacctggaactgtcacctaccagttttccttggcattgtgtcttattagctgtgtaacctggcagggcacttctcagggctcagtctccctgttttaatattacatggataaagtaaaaacaatttcaaatgtgaattataaagattataagagataatcatgtgttcttggcatatagtaacaaatcaataactgtgagcaatgattattagatttagatgtttttgttgttttcctgaaaatgttgtctattagtgagatacgttggcaggtgttcatttatcaaacccagtgtttccaagattttctccttataggaatcactgaggatatttatgagacctagagatccctgtgcccttttttagaattgtagaggatccaaaacagcccaggaactggtcttaacaagttttccaggtaattcttagggctagtaaaatgtggaaaatactggaaaagtgagtttgatttatgggaatgaagagaaaaagagggtacatttctatcatagagcgttcccggcatgagcatgttggaaatatcaatatttaggggggttccttgtttcatgtttgtttcctgacataatgagtatttgtgcaagaattccattgttgtatttttccttgacatcttctttaattatctaattcaattaggtgattgatttagtctgcctcttacttgaatttttgttattgctgcataccccattgataagtataaaaatgatacgggaatattaaaaaggacatttatactacttttcagtataaacgccagctgcagtagctcacgtctataatcccagcactttgggaggccaaggcaggacatttgaggccaggagtttgacaccaacctggtcaacgtagcaagataccttctattaaaaaagaaaaaggaagccgggcatggtggctcatgcctgtaatcccagcactttgtgaggctgaagcaggcagattgcttgaggccaggagtttgagaccagcccggtcaatgtagcaagactccttctatttaaaaaaaaaaaaaaaaaaaaaaaaaaaggaagctgggcacggtggctcttgcctgtaatcccagaattttgtgaggctgaagcaggcagatagcttcaggccaggagtttgagtccagcctgggcaatatggcaaaaccctgtctccaataaaaatacaaaaattagccaggtgtggtgacaaacacctgtaatcccagctactcggaaggctgaggcaccagaatggcttgaacccggtaggcggagattgcagtgagacaagatcaggccactgtactccagcctgagcaacagtgagactgtcaaaaaaaaaagatggatggatggaaggaagggaggaaggaaggaaggaaggaaggaaggaaggaaggaaggaaggaaggaaggaggggaagaaaagaaaaggaaagacaagggaagggaaagacaagggaaggcaaaagaaaaccaattttcatcctcttgactcacaagtttgagtctagcttttccctttgtctgctatcgtcttttggattatgagtttctcctaatatctcatgatatttcaatgcgaggtaattgcaattaattatcatagcaacactttatctgtcttctaagaaaataagtgtcccacactggggcctgtaggagtgggggtaaggggagggagagcatcaggaagaatagctaatgcatgctaggtttaatacctaagtgatgggttcatctgtgcagtaaaccaccatggcacacgtttacctatgaagcaaacctgcacatcctgcacatgtaccccagaacttaaaagttgaaggaaaaaaagaaagaagataggtgttccaagaaaaaaaatatttaaaagataaaatatgtggagcattacatcaggtcttagaatgcgttcttggagggagaactattattgtttgcacttatctgctgcgaagatatatttcaactctatctaatcccggtgtcacagcaccagaggatgctaaagattaccattttcaaatgagccagctgaggctagagaggctacctgattgaccaggatgaaatctaagagttttcccaactccaaagttagtattctttcctctacattatcctgcttctcatttatctcattaaaattctgttagctgggatgtgctttatactggagagcacagagaacaatctgtataaaaggatttgcaagagacccagggagccctgaaactgagatgattttccccacaacctatcctgctgggcatggtacagatagacacattcacatcttagcagatttgggactttaagggcctcttattaaaatgtaaatatgcctggaggaatcactcctaaacccatactgggataacattttatctcagggattagttgatcaaattggtttccaacctagagagttgacagcaataccctaaggtgaagagggggcactacgggtgggggctgtcagggtaggcagtgcaatataacaggtttctaaaactttcccttctttacagatttaaacaggaacagctctgtctaatttttttagctctgaatattttaaataaagtgactacttaacaaaataaattctgagtggataggcagaatcaataatactgcaagcttgaatgtaagcctagtgacaatgacatgggtctttagactatttgataagagcttaaattgaagttaagatctgagcttgtgaaattttaatgtttatatattataagtgaagcagaatctattcatttttctgtgctctttttttaaactcagattttcgataagataggaagtccagattgcaatttaaaacatctcattttttatgcaaattgagggaatcctcaatttgcaaatcactattgctgagtaaatttttaatttttaaaagttctgccttccattaacatgatcgtcagtaataattgtattctgtttgttccctctgctttttattcttttccccaccttcctgtgggttgcctgaatatttgcttagaatttcattttgattaatctatagtattttttagtatacctccttgtacagattttttttagtggtagctctagatagtttacacacatacatatacacatacatatataaaataaaatttatatacatataaaatatttacatatataaaatatcacagtctggtttcaacattttacaagttcaagtcaagtgtagaagctttacctccctttacatccctctccctttttataatataattgataattctatttatttattctacatacattgataatcacatgaagcaatgttataattttgcttcaaacacaatttaggaaacccaagaggagaaagaaagtctattgtatatactggtatttttattatttctgttgttctttcttccttcctgatattttaagatttcttcatttaaaaaaaaaatcattttctgtctgttttaaaaacttccctcagccattatttcagggtaaatccgtttaaaacaaactcttagttttccttcatctgaaaatgtcctcatttccctttcattgttgaaagatatttttgctggctatagaactctgagttgacaggtattttcacactagaaaaattttaccacttcttctggcctccatggttcctgaagagaaatctactgtctttaaaagtgcttttttttttctttctttctttcttttttttttttcagatggaatctcactctgtcgcccaggctggagtgcagtggtgtgatatcagctcactgcaacctctgactcccaggttcaagctactctcctgtctcagcctcctgagtagctgggattacaggcatccaccaccatgcctagctaatttttgtatttttagtagagacagggtttcaccacgaaagtacttttctcctatagatgaagtagtgtttctttctcatagctttcaacatggtgcttttgtccttagttttctgaagtttgactatgaggtatcttggagtgtatttctttgaatttattctatttgggatcactcagcttcttgaatctgtagattagtgtcgtttgtgaatttggggacatttttagccattatttttcaaataatggcttgacttcaatggcacaaatattagatcttttgttatagccaatgggttcctgaggtgctgttcattttttttccagtctatttttttctgcttttcagattggccaatttctattgttctatattcttgtacattaatcatttcctctgttctccctattctgttgctgagcccatcccttgaactttttaaatttttgctgtatttcttaattctaaaatttctatttcttttttctttttatactttctatttctttgctgaggtttctattttttcatttgtttcaagtgtttgtgtaattgcttattaaagcatttttattacagctgctttaaaatccttgtcagataattctaacatctgtgtcatctcagtgttggcatctgttgattgtcttttctcattgaagttgggattttcttggttcctggtatgaatgatatttgattgtatcctagacattttagatattatgtaatgagactttagatcttatttgaatcttctattttattagaatattctgtttcactagagtactttaaccttttactgatggagaagaagggggtgatgccttgttactgctaggtaggggttgtaagtccaggttccccatgtggcatccactgacagcaccccaatagagaggctgggacacctcattgcagcctgatgagggtggaactatagatttcctactcaaccttcacagtaggggtggggctgcagtttttttcatggtgtttgcctggagtagagtgcttattgtcttaatttttttgtctttctagtcttccacttttctggtcctttggctagggagagtgggcttttcttgaggatttttttttttttttttttttttttgtctttgcctgttggagtttttagattgctggcttctccggaactaagtctgggatatctgaggcaaacaacaacaacaacaaaaaaacccactgaactcactgctgtgtcttttcttaggtcctgaagtccctagctggtctgccttctctccacctttcagagtcttcttatgtttgttttataaataatgctcagggttgttatctgtacttaacaggagggacagggagcagtacatctactcctgctggtcctagagctggaagcctccgcattctcacattcctacgcctctgctaacagcgctggctccttatgacctactgaatcaagacccctctgcttttggctctagaaagtcatacacctttctctaggactctgtgacctagatattggcagacacaaaagattctcctatagaactttacttcaaatctgcaagtagactgaaagctaaacattgttgtttgttatacttcactgtgcccagcagaagtactattagtggaatttctgcataacgggataatacctgggggacgctacctgttgcttctgactgcttccttgacttttatgtattttcctgtaacaggtgaaatacatatgggaggtcaagaacatttttatatggaaacccaaagcatgcttgtcgttcccaagggagaggatcaagaaatggatgtctacgtgtccacacagtttcccaaatatatacaggtaacatggggccattgtggagaggacatggctaaatgatttctggccagtgaaatatatcaagagcaattagaggtaaaagtatatttgggaatttgaggtggggggattgcttgaacccaggagctcaaggcttcagtgatctatgatcacaccactgcactccagcctgggagatagagtgagaccctgtctctaacacaaaacaaacaaaacaaaaccaataatgttatttcttcagggactgaagaaatattgagtattaatagccatattgatttcagtattaatagccatataagttcagtgcttttaaaagagtgttattaaagtgggagccttttgtttgtggattgtagctttaaaaccagttatggaatcagcagatctcttgctcagctcttggcaccactgttaggaacacaagagaagaaagaggaagacctgctctccaaagcctatggtgcctaactcacaggaaacagttaagaaacaatattgaaaattatgcaaccaggtgctaaatcagcaaaggcaaaatttatgtgggtggagaaattaggaaagagtttgctgagggctagaatcatccaggaagtcccacaaagaagtcttaagtttggattcagaatgagagtgaggtttgtctagatggtaagacaagagaggtcacttccaggcaattccacagcaagatcaaatgacacccattcatttattttctcacctcttctgcaaacatttgttgcctgtgtcctgtaccctacgcagcatgcatggaaggaaggaggaatagcacaatgaccgccccagctggaatgaaggggtgcctttaggaaagctaggtttaagcatcagggtgagagtaagggaaatgaggcagggggtcttgattctggtcataaggagccagtgctcttagcagaggagtaggaatgtgagactatggagaatgaggcctcgtaaaaggcaggatcctaaagagggtcagacgaactccattccaggcctgcttttctcttcactctccgtgggatgttgggtccataacctcatccgtctcaggcttcccatctgtaagaatcaattgttaagactaaatgacccctaatcattaggatggcagaaaagagtgagatctgcatctaggaaagaccaactggtcatctttagcagcaatccaagcaagaagtgagaagtgctttttttttttttttttttttttttttttgagacagagtctcgcttggtcacccaggctggagtgcagtggtgccgtctcagctcactgcaacctctgcctttcaggttcaagcgattctccggcctcagcctcctgagcagctgggattataggcacgcaccaccatgcccaactactttttgtatttttagtagagatggggtttcatcatgttggccaggctggtctcgaactcctgacctcaggtgatctgcctgacttggactcccaaagtgctgggattacaggcatgagccaccacatctggctgagaagtgcttattttccagtagagacagtagaatgcagggaaaagacccatgctgagtgaggcttagaagactgcaaaatcccacagctttgggaaacgtatgcctagggattagtgtgaatagaatactttaggagtggttcctggggaaaatacaaaaaagtatgagtacaaaaatatctcactggtaatgaaaacactactaattagttttggcaatgtcattatagccaagtattgctgagatcagttggggctgtgggccagggttgttggacattatcccattatttagcataaccacacagtatgggtatcatgtgcaacattaaagaatcaaaacatctagtgactgtcacagtccatttcaggggacaggttttttgttgttgttgttaaaatcatagatgtgacaatgacagtcacaattaagtccttgctgaagatggatcagattaatcagaactattattgttcacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaagtaagtggagaaaatctgctaaaaataaagtgaagtcacactgaaagttctcactgtcagaatcaatgaggaagaacctgggccaagattatttaatatcacatatacgatacaaacacacaaacaagctgccagcttattacacttacttgtcttatattgtcctatagcaaccaaaataagagtcaattactgaaaataataaaagccacagaaaaaatataatacctagaaagtgggcagaaacaggtcctgaatgggtgggagttacttgtcctcagcacctgctggactgagctatatatgtagaggtcatatatatggctttttgaacaatgtacctatatatacatacacacatatatatttatatacatataaaccatgtacctatatatacatacacacatatatgtttataaacgtatatgtatgtttgtgtgtatatatgtacattcttcaatatatcaaagatatttttgtaaaatggggtcccatatacacacatacatatatacatatatgtacatatacatacacatatatacatatacgtgtatgtatatatgtgtatatatgtatatgtgtgtatatgtatattttcttgatttaaatatagactttgcttttgttatgcttacattcatttgtatcgccattttcctttgaggatctcaaaaaattctcatgtaaaattgtctctggagcaggcacacctagaaggcttaatttgtttgctgagtaatatgggtcagttcctccatcccaggaagcaaaaataccttgattccagatctctcctatcagggagcacttggtagttagatctgcattcttccatttgtggccagtctaaagaccttgggacgatttgcctataataaaggttgttattacaatgggaaatgcccccaaagcaatgtcctggagcccctggcacccaagagcctctgtcccacaagttgcaaatgcctggcattattccctgacctaacgggaggaaagcccacggtgtatgcctgagatcagcagaggataggcatgcgaaatagttgtgttgttctgtgaggcgtgtaggctccactcaggctcttgccaggagttatataaaccccagagaatgcctgctaggtaaaagaggttacctcacttactttttttctgttttagacatggccgtgcagttcgctgtgttctggaacgaggagaagacatgttaataactggaggccgccatccttaccttggaaagtacaaagtgagtacaagagggcatggaggaaggatttatgttgtagatacaacatcctatcagtgcgcagggcagtctttggctactctctagtggggagtaacaatgagcaaatcaaaaacagagcatctatttaactttctattggttgcactgacttttaattactagctggttcaatggaggcttttctgcttagctcaaagatgtcagtttcagaaataaaacactaagtgctagctggtattggctgtacagagcaaataactagaaaacgtgagtgtgtacgccattaaagtagatctgattaccatacttcttcccacatataaaagaggtaaaagtagaataattctcataacagtagtgttatgtgaaattgcaattatttgtaaatgggttcctcattcttcaatatatcaaggatatttttgtaaaatgaggttccagaaattcatagaaaaaaatttgtagtagaaaatagtgattcttttgctttataagaaaaattttacttctcagagtgggctaacttctctaagaaacaacttaaaagctcttaaactttcattacgtcatttcttgctcaagtaacagctcaatataatgctcaatataatcattgaggggggaaaggggaggattctgctttataaaatcattcagggactggagctgtttccatttattggtgccactgtgccctcagactgcatcatccaatatagtggtcactaggagcatatggctatttaaatttaaattacccaaattaaatacaattagaaatttagctccatagtcgtattagctatattccaagtgctcagtaggcacatgtggttagtgtctgccatattggacagtgcagacgcagaacattgccatcatcacagaaagttttattgggtatcactgccctacaaactctgagtcttccaggggatcttttgctgagggcagcagacagggaagcgagagagaagagagcatggagtgtcacctggtaggtgttttaggttttaggcaccggacctgtaagttgtggatctcacttgtatccagatgtcattggcgagacctctgtcacctaactgtaagggaggctgggaaatgtcatcttcctgtgtgcccagaatgaaatacaataggatttgttaaatgcatagcactgtctccatcgcaaaactgcataactaatacatgttttttaggagataatgaatgtttccatttcaaaccacactcactctaaactgtattttgaatttgatttagctcagaaagatttgttacagtaaacttcatcctgaaggagattttttttaataagacatatatgaagtcattatgaaaatataacaatctcaggttaaaagatggagagatgaatatgaattggaatatatataggcactttgttaaagaaggtaaaagataggtcttcaagaatggaggccaggcacggtggctcaggcctgtaatcctagcactttgggaggctgaggcgggtgaattgcctgagctcaggagttagagaccagcctgggcaacacggtgaaaccctgtctctaataaaaatacaaaaaaattagccgggcatggtggcaggcacctgtaatcccagctacttgggaggctgaggcaggagaatcgcttgaacctgggaggcagaggttgcagtgagccaaaatcgcgccactgcactccagcccgggtgacagagcgagactccatctcaaaaaaaaaaaaaaaaaagaatggataggcagaaggaaggcatgccaggtgtgggaatagtaagagcaaaactacagaggtgtaataaacatggcatgtttgatagaggcaagagtaaggggagagggagaattagaacacagagcacttcctggaaggtagtaaaaaataggattgatgggtttaggtgatgcctgactgagaggggcctacagtcccagagtgggaagtttaaacttgatcttaaaagaaacagtgagactgagtggatccttgaatggctcagtgccgtaattaaacacagatgctttggggagggtaacaggatagtctggggaggagagaggatggaagctggtagacagcgggaggcagctgatgcattcagacatgaagcacatggggtctgagatatgacagtaagttgtagaagagatgggtccaagagccattatagtgtaaaataaaagagaattggtgaaaatcttggcaaaatgctatgaagaatacaaccgcaaacatgacttggagggttttagaagaaagcgacaagttggaaggaggaaccgatctggaagaacgatgaagagcttgtttgtgtaaatgctgggggtagaagtgacaacaggaccctgaagcagaaatgtcctttaccaccatgggactttgctgaaaggactggattatagtgacagaagccattgtcataatggtgactaaaactatgagaaaataatgttttctgatggagagtagtgtgaggaaaggtgatatgaatactacttacgatactattattaattatatttagagtacttgctatgtttcaggcacttgcctataattttctatgtgttgccttatttacttccatttcacagatagtctgagtggttacacagcttgcctaagatcacagagctagttatatactatccgagaaatcactgccaaatccaatgtcatgacgcttttcccctatgtgtggagggtttgcaaatgacaaaatttggagagacttggcccctgttccagcattcgatatcggttctcttccccaggctggattcatgaacgatggcagaatcttggccctggacatggagcattacagcaatgcaggcgcctccttggatgaatcattattcgtaagtgttttaaggagcaagttcacattcctgaaaagagtgttacataaaataatttaacttagaaaatgcccaatagttaagtaatatttgattataaaggtataatgaccatccttgcagggatagccatgtgttacttcctggtgcccaaagtgtgagcccagagatgctggctaagttgcatctgtgtgttaccccccggcttcccatacttagagctcttttcctagatgcacacatgagaccaagctttctcagttttggccctattgacattttggagtgtgtagctctttatggtggggactatcctgctcattgtaccatctttggcctctacttagtaggtgtcagtggcattaccaccctgtagtctttttttatttttattttttgagacagagactcactctgtgcccaggctgtagtgcggtggctcaagcgatcctcccacctcagcctcccaggtagctgggactgcaggtacatgccaccatgcctagctaatttttttttattattattttgtagagatgggttctcactatgttgccagagctgatctcaaactactaggctcaagcaatcctcccatcttagcctcccaaagtgctaagattacaggcgtgagccactgtgtccagcccaaccccaaacaaaaatgtttcaaccaggccagacgcagtggctcacacctgtaatcccagcactttgggaggctgaggtgggtggatcacttgaggccaggagttcaagaccagcctgaccacatggtgaaatcctgtttctactaaagccgggtatggtggcacacacctgtaatcccagctatttgggaggctgaggcaggagaatcacttgaaccccggaggcagaggttgcagtgagccgagatttcaccattacactccagcctgggcaacaaaagtgaaactctgtctaaaaaaaaaagagtttcaaccaaaatgttaacaatgaaaaatgtctccagacattgccagacgtccccaggagcagggaaaggattgctccccattgagaaccaatacattagacccaatgccaaaacatttttttctgttttcactgtcttccaggatattatattcattacattctatagacccagtgctcagggcctgtgaacatatcaaaggcctttgtatatatttgaaatcttaaaaaatgcattaactccaaaatacaaaaataaaaaataatgctctcaaaggaaaaattattctaatacttaaaaattattttacagcaaaaaatgtgtttaattgggggcatgggaatattttagcatgttagatgagatgaaaagagagctgccattttcggcctggttttggtctgaggtcgtaggatggtgaaacaggttcagaagatcttaatcacatcaactctggatttctccaggtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtaatactaaatcagcttcacagacaaaacatgtggaatgtcagagacggtagggcctttgggggccattcaggttgaggaatttgagacccagaggggcaaatgatttgtgccaagtcccccagctaactggttaatgcggagcccagactccaaagttcagcaatactcaccttactcagactcctgctccaaaatcctgaagcagaagatcctgaggactgagcactgcattctcccctggctggtgagaagcttccattggctgggggtataactgctacccacaattccatcaaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatacacacacacacatatatatatatatacatacatacatacacacaccacagtttctttatccactcattgattggtgggcatttgggttggttccaagattttgttattgtgaattgtgctactataaacatgcaggtgcaagtatctttttcgaataacaacttgttttcctctgggtagacacccagtagtgggattgctgggtcaaatggtacttctacttttagttctttaaggaatctccacactgtcttccatagtggctgtactagtttacattcccaccagcagtgtagatgtgttccctgttcaccacatccacgccaacatgtactgttttttgattgtttgattatggccattcttgcaagagtaaggtggtgtagcattgtggtttcagtttgcatttccctgatcattagtgatgttgaacattttttcatatttttgttggccatttctatatcttgttttgtgaattgtctattcatgtccttagcccactttttgatggggtcgtttgtttttttcttactgatttgtttgagtttcttgtaggttatggatattagtcctttgtcagatgtatagattgtgaggattttctcccactctgtgggatgtctgtttactctgctggctgactgttccttttgccatgcaaaagctctttagtttaattagctcccagctatttatctttgtttttatcgcatttgcttttgagttcttggtcatgaaatccttgcctaagccaatatctagaagggattttccaatgttatcttctagaattttaatagtttcaggtcttaggtttaagtccttaatccatcttgagttaatttttgtataaggtcagagatgaggatccagtttcattctcattacatgtggctagccatcctagcaccatttgttgaaaaggatgtcctttccccactttacgtttttgttcgctttgtcaaagatcagttgggtgtaagtatttgggttctctattctgttccactggtttctatgtgcctatttttatacactactacaccattttgttgactatggccttatagtatagtttgaaatcaggtagtgtgatgcctccagatttgttctctttgcttactcttgctttggctatgcgggctcttttttggtatcatgtgaactttagaattgttttttctaattctgtgaagaacaatggtggtattttgatggggattgcactgaatttgtagattgcttttggcagtatagccattttcacaatgttgattctacccatccatgagcatgggatgtgtttccatttgtttgtgtcatccagtgttttgtagttttccttgtagaggtctttcaactccttgattaggtatattcctaagtgttttattattatcattattatttgcaactattgtaaaaggggttgagttcttgatttgattctctgcttggtcgccattggtgtatagaagaactactgatttgtgtacattagtcttgtatccggaaactttgctgaattcttttatcagttctaggagctttgtgaaggagtccttagggttttcaaggtaaatgattatatcgtcagcaaacagtgacggtttgacttctctttaccgatttggatgccctttatttctttctgttgtctgattgctctagctaggatttccagtaccatattgaagaagagtggtgagagtgggcctccttgtcttgttcccgttgaatgccttcaactttttcccattcaatattatgttgaatgtctttaacttttccccattcagtattatgttggctgtgtgtttgtcatagatggcttttattacattaaggtatgtcctttgtatgctgattttgctgagagttttaatcataaagagatgctggattttgtcaaatgctttttctgcattgagatgatcatgtgatatttgtttttaactctgtttatgtagtgtatcaaatttattgacttgtgtgtgttaaaccatccctgtatccctggtatgaatccctcttgataatggtggattatgtttttcatatgttgttggagttggttagctagtattttgttaaagattttagcatcaatgttcatcaaggatattggtctgtagttttcttttttggttatgtcctttcctggttttgttattagggtgatgctggcttcattaaatgaatttacttaaggttccttctttctctatcttgtggaatagtatcaaaaggattggtaccaattcttctttgaatgtctggtggaattctgctgtgaatccttctggtcctggactttttattgttggtaatttttaaattaccatttcaatctcgctcttgttattggtctgttaagggtatctaattcttcctgatttaatctgggagggtgtatttttccaggaatttatccatctcttctaggttttctagtttatgtgcacaaagttgctcatagtagctgtgaatgatcttttgtatttcagtgttgtcagttgtaatatctcctgtttcgtttcttagtgaggttatttggatttttactcttcttttcttaatcttcctaacggtctatcaattttatttatcttttcaaagaaccagctttttgtttcatttatcttttgtactttttttccagtttcatttagttctgctctgatcttggtaatttcctttcttctgctaggtttgggtttggtttgctcttatttctttagttccttgaggtgtgaccttagaatgtcagtctgtgcactgtcagtctttttgatgtaggcacttagggctatgaactttcctcttagcaccgcgtttgctgtatcccagagattttgacaggttgtgtcattattgtcattcagttcaaagaatattttaatttccatttgatttcatttttgacccaatgctcattcaggagcaggttatttaatttccatgtatttgcatggttctgaaggttccttttggaactgatttccagttttattccactgtggtctgagagagtgcttgatataatttcaattttcttaaatgtattgagcttgttttatggcctatcatatgatctatcttggagaaagttccatgtgccgttgaatagaatgtgtattttgcagttgttagataaaatgttctgtatatatctgtttagtccatttgttccaaggtatagtttaaatccattgtttctttgttgactttctgtcttgatgacctatctagtcctgtcagtggagtactgaagttccctactattgtgttgctgtctatctcatttcttaggtctattagtaattgttttataaatttgggagctccagtgttaggtgtgtatatgtttaagattgtgatattttccagttgtacaaggccttttaccattatataatgcacctctttgtctcttttaactctgttgctttaaaattggttttgtctgatttatatcagacagaatagctactcctgctcgcttttggtgtccatgtgcacgaattgcctttttccacttctttactttaagtttatatgagtccttatgtgttaggtgagtcttctgaagggaacagatagttggttggtgagttcttatctattctgtggttctgtatcttttaagtggagaatttagaccatttatattcaatgttagtattgaaatgtgaggtaccattgcatttgccatgctttttgttgcctgtgtactttgttttttatttttttgtttttgctttttaacatgtatttatgttttataggtcctatgtgacttatgctttaaagaagttctgttttgatgtgtttccaggatttgtttcaagatttagagctgcttttagcagttcttgtagtggtggcttggtaatggtgaattctctcagcatttgtttatctgaaagcaactgtatctttccttcatatgtgatgcttagtttcactggatacaaaattcttggctgataattgttttgtttgaggagcctgaagatagggaacaatcctttctagcttgtagggtttctgctgagaaatctgctgttaatcatgtaagttttcctttataagttacctggtgcttctgtctcacagctcttaagattctttccttcatcttaactttggataacctgatgacaatgtgcctacgtgaagatctttttgcaatgaattttccaggtgttctttgtgcttcttgtatttgatgtctaggtctctagcaaggctggggaagttttccttgattatccccctgaatatgttttccaagcttttagaattatcttcttcctcagcaacactgattattcttaagtttggttgtttaacataatcccagacttcttggagattttgttcctattttctattcttttctccttgtctttgttggattgggttaattcaaagaccttgtcttcgagctctgaatttctttcttctacttgtttaattctactactgagactttccagagcattttgcatttctaaaagtgtatccaaagtttcctgaatttttttattgtttttttctttaagctatccatttccttgaatatttctccctaacttcttgtaacttttttaaaatttctttgaattgggctttgcctttctcttgttcctccctgattagtttaataactaacctcctgaattctttttcaggtaaatcagagatttcttcttggtttggatccattgctggtgaactagtgtgattttttgggggtgttgaagagccttgttttgtcatgttaccagggttgcttttctggttccgtctcatttgggtaggctctgtcagaaggaaagtttggggctgaaggctgttgttcagtttcttttgtcccatggaatgttcccttgatgtagtactctccccctttccctatggatgtggcttcctgtgagctgaactgcagtgattgttgtctttcttctgggtctagccacccagcaagtctacccagctcccggctggtactgagggttgtctgcacagagtcctgtgatgtgaaccgtctatgggtctctcagctatggataccagtgcctgttccggtggaggtgatggagggtgcagtggactccatgagggtccttagctttggtggtttatgctctatttttgtgctggttggcctcctaccaggaggtggcactttccagaaagcatcagctgtagtaatgtggagagggattggcggtgggcagggccctagaactcccaagattaaatgtcctttgtcttccactaccagagtgaatagggaaggaccatcaggtgggggcagggctaggcatgtctgagctcagactgtccttgggtgggtcttgctgtggctgctgtgggggatgggtgtgagattcccaggtcactggagttgtgtacctaggaggattatggctgcctctgctgagtcatgcaggttgttagggaagtaggggaaagccagcagtcacaggcctcacccagctcccatacaagcagaagggttggtctcactcccaatgtgtaccccccaacagccctgagtttgtttgcaggcagacagtgtgatgggcttgaaaacttgccctgtgctgcacccctagctgagagagaaaagggcttggtttctccccctgcctgtggagtctgcacaccagatttgtgccctcccactgagctctgaccaggaggcttcttgccccattcaaattgttacaaagttcagctagagatttctttctccctgtggagtttcaccccctacttctctggtcccccgccccctccgcccccaccatggatccctgtgttgttaggcaggaatggcctggcctgctaggggacacagcaagctcctagggcctttctgctgcttcctctacccctgcattttgcttggctctctaaattgtctcagcttcaggtaaagtcggaatcttctcctgcaaacagaatttcagcttctcccgtgggggtgtgtgtctgggagaggaggatctcccttccccctcacagctggggcactcacggtatttggggtatctcctgggtcctgcaggagtagtccacttccttcagagggtttgtgggtcctctcaggattattgctttgttcttgcagtcgatctagagctaaaattcggcgaacttccacaagctgctctgtccagagctgcaatctagtcctgcctcccgtccgccatgatgatccaatttctccttttggttctttcagtctcagccccaactttgtttattgacaacgaccttccccttcctggctcctcctcccagatcctggaatggaattagtgtggggagatggggtgagctctctctcagccccttctcctcccctgtgccttctgctgtgatgctggtgcaaggaggaagagaagaaggaccaggaaaacagtcagtttctccctgtgtgacttctcccggcaagctcacagtcctctctttggacagatgtcacttttcaagtacattgtctatggctccatttctgccagctcttccagaaattggcagtccttggaccttcagcgggcagctggcacagcattccactggtgaccacacctctctgctcatgccccagcagtctttagaaggccccaggtcccaattcatctaccagctttcacccaacagtagccactttctttgcttctcttgaacgtgtgggaggccttgcccctcccttcctggccatcccactaaactctctcctgatgtcctgccacatttggtagcactaaggaggagaattacatccttcccttcattcccagggaagttagagcagggaacagcctcttaaaaacaccactttcccccaaatgagatggcttactaatttccagtgtttctcttacaatgatctgataatttgcttcggagggtggggagagtgtgtctgtgatggctctgtcagcttagggagggggctggccacaagtgctatgagttttctcagctgagaatgtgacatacttggcaccttttattctcagcttagggtcttagtcaccaattctgggaatacaggaagaattctactcagtgcttcagacatcctgggatagaatcttttaatttgttcttcatcctagatattggttatatttaaacgaactttcatgcttgcctgttttggaggtgagtagtcttatcttgcaacatagcatgggagtaatccaaatcatgtggcctagatgatctttcagcagatacccaaatgcaactagaattaagagtctacagtgtacatggactgtgttgagttatattggaacataaggtaaaggttccatcctttaaagttgcacaagagtagcatagaaagcacataagtaattgctagcacgtttgatagaagctctgagtagaggaagaggacaatgttgtgcattaggaaaggcttccacaaggactcagtagaacttggcttggaccttacaggatgggcagaatttgaccaggaggatggtgaatggatgagcctatgtctgctgggtttcccctcccagctttaatctccttttctttcataggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggtgagttctccaaatgcacatgaggatgctgcctggaagcagccctgacaaagcaagaggtgttgaggaaacttctccttaagtcatattagccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgctcatgtggaaagcaggagggtgggactgatgacctccaagactcctcttccagtgtccgcaattcggtgtcgctggaccatgaaatagaaatgaggagctgcaaggttttgggtgctccactccttctgggtgggttggaataaattaaattcagaaaaataaatcactttttaaatagaatttttgaagtttattcaccttgtaccttttaaaactgtgaaaggggggactgggaatctgctcttgcagtttaatttctttcattgattaaagaaatccccttgcttggttgcagtttccacctcttcattcttgacttcattcattcttaagaatgaataaaacttacccctaacggctggtgaaggactgcaacattctagctcattgtatggcagccgggaacccctattatctattttattacatacacacatccatgtacatacagataagctgggaggaccctcacaattgtcactcctctttgcagaattcactccttggttggagtcatgaagaaggcatggcagctgtgctgagcgatcacaaaataggaacaaatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattgtaggcaggtggtaggtcagagaagtgttataacaaatgatgatcttattgcagtcttctcattccttgcctgtttgtgatggcaaaaaataacacagagccatgtagtcatctgcatgcagtttactcaaatgtgggagacagtcaagatactgtggttgagaaataaaagcaaaaacgaggttattacaaaagaagagagaaagaaactaccactgggaaaagggtttgtaagcattgagtcttggtatagaattttggggtaaactgattagctggcagctaccaaagaggtcagctggggctgtctgtccttgtgcagactagtcaggatcatcaggaaaaacagcctccattgttcatggatcctctggaaatcctctcacgtttggccgtgggtaaacatggcgcactgcctctatttgatggctgccattactttatatctggcctccaccatagaccaggtctcacccattttcctcatcagaattttctcaaaaagtagatttgaaaaatatggtgaggtgcagtggctcacgcctgtaatcccaacactttgggaggccaagacaggagaattgcttgaggccagaagtttgaaaccagcctgagcaacatagtgaggccccatctctacaaaaaagaaaaaataataatagtgacaattactgagcactacgatgttgtaagtacttttaggtatttcatttaatcttgggacaacctagaagatttgtatcctcattttaggtataaaaaaaatctaggcttagaaggtttaaataactggctcaaggtcctgcagctggtagaggtaaggctggggctagaactcaggcctgagtggctctgaaagctgggttttctagttacaccacgtggtctccccaaaacaccttttgataggaactgaagtgggattcagctcagctgagaacaaactaggcaacagccagcagtacaaattcattcttgaaggccacctgggaaactgaccaacttacgtgctgaaaatatttacttagggctgaatcaaggagtttgagaccaaactccgtggagggcacatgctaaaagcctccattctgaaacaaactaaatagaggaggaaactagacatgatatttgagtgccttctccatggaaggacctgggctggggaatttgtaatctccacttgattattctctatctcatctctatcaggtaggtatgaatctctctatttcacagaaggggaaactgaagctcatagggattctctctgttgcccaaggacatccagccaataaatggcagaacaaggattcaacttcagcaccgccttcatcgtcccacagggcctccctgagcagaggcagtccctgcccagcagctgagggggtcaaacgtgccccacctgtgttatgcaggcataccttgttttactgcactctgctttattgcacttcctagatgctgcattttttacaaattaaaagtttgtggcaaccttgcttcaagcaagtctattggtgccatttttccaacagtatgtgctcactctttgtcaccttttggtaattctcacagtgtttcaacctttttcataattatggtgatctgtgatcagttatctttgattttactgttgtaattgttttggagcaccatgaaccacatccatataagacagcaaacttaataaatgttttgtgtgttctgactgctccacaaatagaggagcattcttcccccatttctctccctctcctcaggcctccctattccctgagacacaatgatattgaaattaggtcatttaataaccctgcagtggcctctaagtgttcaagtgaaaaaaagagtcacaagtctcacttgaaatcaaatgctagaaatgattaagcttagtaaggaaggcactgcactccagcctgggtgacagaagagaccctgtctcaaaaaaaaaaaaaaaaaaaaaaaaaaacagaaaagaaattgttacaactacctcctcaatcgtcagcaaccaccaccctggttagtcagcagccatcaacattgagaaaagaccctccaccagcaaaaagattctgactctctgaaggctcagatggttgttagcattttttaacaaagtattttaaaactaaaatatgtacaatctttttagacataatgctagtgtacacttaatagagtacagtgtagcataaacacttgtatgcactgggaaacaacgaaaattgtgtgatttgctttattgctgtggtttggagctgaacctgcaatatcagtgtacttacttcctgcagtctgaacactgaatggcacagacaggacctaaccaacctctgtgtgtccaatgccttactatggcacttggcacagagtaggaactcaaatgtctgaatggctgaaacatttggggaatctgcgggtttgaagctaacttctcatcgataccagtagtatttgtttgaagatttaaatttccccgactaggtcctctacttatgttggaggaccatctactccagctctccagttgtgcttgttttatagatgaagctttgcagaattatcttttgtggcactaacaatgagctgtacagtggtgccacttaactaaaccaaatttgacattttaaatggcccaaggagattgcagcaccacatggaacaaatggctgagtgatatctgatagacatgctgtcttggacatacaggctgaatgctataaccagcagggtcacacaatgttggaaaagtataatccactataattgtagcttaatcacatgggccaagtccaactatgaattacatgcacactttgcgagccaaggaggccaaatatggagtctacaagattaagaaacagattgcatggctatgctactgcaaatttacttaccaaacatttactgagcacctaccgcatgtgtgttgctatgttgcattccgagagattccttaggacgtgatccttcctttcagggggctcatattctagcaaagcacaatgaagtgccatggaatggggcccaggagctattgttgcagctggcatcacctgacatctgatgcatggcccccaggcagccagccctgggctctctgtagaggaaaactcttccttacctttattattttgaggatgaatgtccaggagcaaaagatggtgtttccaggagtcatgagtcaataaacagtaaaaaacactctattacatcttcccaaggtccttgggtgtcattatcatggctactatgccttcctcaagagtctaagtttctcctttggactgtggacatatgtgcctggtcctcagagaaagggtatcctgatgtccccatttgcccagtacatccctagtttacacctgccgaccaaataaatggagtgcattttcactgtcaaacttgccttatttggaatgatagaggtttctggttgtcattcacgggggtaatgtgaacctttggatacaaataaagagacagttctccaagcatggtccacggtccccaggcagcttggaaggcccttctgatgggcagagaattgatctggaaatgcagtctttttcttgggtttatctggtgattaacatgcagttccatcaaccttcacttaatgaccagggttgcttacaaataatctaagtgagcaactaaggcttaggaaaatttttggtttattaagttgacattggcttattaccagaattttctgaagaccttgacattacaaatcctagattattatgtcactctgcctaaaaaattagatgtgaagaaacctagctgacccagaccacacccatgcggtcagcacttccctgctgcaaaactgtaaaggttgccttgcaggctttcccggaccacagtggaaccactgagagatatctgttctaggaggaccattgctgctgatgttgctcttacattgcagagccaaagggaagaagccatccttctttcctgctgtgattttctgggatatccccatattctagtttagcacaggcagatacgcaagaaggcacattcttgttaattataaaaacatgtttagcttagagactggatgtttctgattataagagtctttaatgctgttagcagtctggttccttctggatccttgtggggagctatacagttagataagattacttccaagttcttgtctaactccaaagctctgtagttctgtgccaagatgatttagggtgagcttagtcattttgcagcaaaacaattttagtgtctatctatctcatcttatatgggattataagaaaatggatttccattttcatttttctgggacatgcctacaactatgagaatatgtgtgcacacaattattcaccctctccctctacctgtctatactttactttgtattttaaaatagagtccccgccctggtttcccccaccccaaaaagaaacctaaaatgttgctccaccctggggggtgcgggattcttggagggaaatatttccaaggaaaatgttttaattgacacgatatgtgataatatcaaaaagatcacagaaacagttttcgtcttttctgctcaggctgctgccttggttcacatttatcttgatggctctgtgctggtcactcacggtggaattgaaatggggcagggggtccacactaaaatgattcaggtaagaatgcaaataactcgattgagttgggtgtgtgcttatagatctgttcatgagagaaaaactatgaatggatattttctgttacaaaatacaggataggaagctgggtgaggtggctcatgcctgtaatcccagcattttgggaggctggggtgagaggatttcttaagtgaaggagttcgagaccagcccagggaacatagggagattccatctctaccaaaaatatatatatatatatatatatatatttttttttttttttaattagcagggcatggtggcatgagcctgttttcccacctacttgggaggctgaggtgggaggattgcttgagcctgggaggtcgaagcctcagtgagccaattgcaccaatgtactccagcctcggtggcagagcaagaccctgtctcaaaaagtaaaaataaataaaaaacaaaggataggagatttgagctttgacagtttactctgttaaatgattagcagaaactgggtaaacaaaccaattttgcaactaaacccctaaaagaatgtggcagaagaatctcgagttgttttattgctaaagaaaattatatgcttatttgctgctttcctttggatatagtgacagttgagttgtcctttctgagtttttcttgggcaataagataatgtgtaaattctgatgtatttggattatttcttgccctttttgtattacaggctccgaacaattgctaatataaatcacctttgatatttacagtcaaactttatctgtttgcttttggctgtcttattttagattaattttaagctactgtttctcttttgttaatcataatagtaacattatagattataaaatatttggaagcagcagaacattttaaaaaacaaagaccctacacagtttcaccacatagaataatcattatttgggagtctttacatcttgtcttttttgcttttgcaaaaaagtcaccaacatgcttttgtttaattttgtattctgtttttccacccactttatatagcgtgaacactttctcctgtcattaagcagtctttacaatcatgaattgtatgtggctgcatgtggatacatatatgatttatttaaccatcccccagttgtttgaatacttcagtgaatatttttgtacactaacctgtgatcaaatcattgattgtttcttaaaatagacttctgggaatagaattactgggtcacaggtgtgaccattttaaattgtttgacacacattatcaaattgttttccagaaagtatccctctcatgacacccctaaccaacagtgaatgttatggattgttgaaaatttgtagataatttgataagtgaatgaaagtatctcattattgctttcatttacatttttctgagtataaagatgttaaatacatattttctctcagtcacttgagaattgactttccccattggagggtaagatttcagtgttttccttattggatcaccagagactttgatattctaagcctattgcactctgtgtggatgatctgagagccagacctcatggaagggctctgtatgcctgtgtccttgtagaagctgtgggcaagcactttcaagccatgctgctagcaggagagaggcaagtttgggatcaactaaagttagcaatatgattttgctctctagcgctaaaaataaagaataaagcagccagctaagtccttgtgttggcacatggcactggcgccatctcctgtgacccacatgttcatgccgttgcttttccaaggccatcgtcctttctcataggaagcactctttccctggggcaactccagaaatgtggataggagatagacatctcctatcattgataaggttctgctagaattttgcagagtgtggtcgtaggagaagcctcaaagatgtcaatatcatgattataaaaacaagaatgaagcatttcttcctgccttggcctggggcctcacctcctctttctgacactatcaccagaaagtcaaagaaaaagaaagtgtgttcaggacttggggtccagactagctataggatttttagaaacaagaaacttttcatggctggaggaatttgtggttctgctcccttgtccctgtcatgggtatgagggtatcacacatgtgttaccacgtgggcatgtgcacaggtctgtgactaatcaaagtgtttaaaaggaaactctctcttaaaattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggtaacagtcactgcagtggcgtccaaatcattaactccctcagggccaaatacgtgggtgggtggagctccaaagatgctgagagttaatccaactcatatctccttccccatcttgccctcagtcagtggtacagcacccagtggttctcctgtgctggaaatgccacctctttttctccctcactcctgacatttttctaatcagcaagtcctttcaagtctactcaaaaatgtctctgtctttctgcttccatattatgttagtatcactttaagacaggctcgcgcctctccccagggccgatgcaggacttctgtctctccaccacaacttcattgccttttgctctagctttctgctgccggagtgaattttctcacaaaataaatgtggccatgccatgtctgaaagcaatggctggtggttttccaagaggttttttattaagtcttgactttttagcatggcttacaaggccagttctctctctcacacacacacacacacacacacacacacacacacacacgtgcacacactcatatgaaacctttcatatcaccttcatacagggttggtgtcttatttttccatgttccctcttagataagcctatggaatggtacatattatgttgttttgaatttggtgtttgcatgaaattaggagcataattttaatttaaaaataatctctaggatgcctgtcaaactcttctaaaacgcctcgaacccatcatcagcaagaatcctaaaggaacttggaaagactgggtgagaatcaatggttctctgtattttattttagaagaaaaaggagtgggaggagagcaagagcaatgtgcattaattgaaatctgtagaaagggcatttgcaaaggtaccaccattgtgtaatgataaataaaaggccctttggctcttagcatgtggaaatcctatcacagtgtggtggaggaactcttgtatctgggaaaattttctgttagagaaaaagatggttcttctgccagaactcctgttttaatccagaattaattaatgtttcatcctatgtagcctaggggttgtctagataataactgtacatctgttttttctctttctttgggttctgctgttcctaaaatagaaaaacaatagtagaaccactctgtaaaagtaaaaatcatataagcactcgtttagaaataggaaaccaagccagtgggtatatgttcatccagtaataggtactcaatggaatggaaatactcaactgcttcctttgatctgcttataatctagttggaaaagaagacacattctaaagtcagctaacaaacttttcaaagtaatagtttatcaactaccagatgttgtggaacaaatatccataaaagctgggagcatgtgtcacgctggctattctagaatgtcagtttttgcaaccttacaaatacaggtctgggggaaataacatttgaggatcccacttagaaatggtttctgctattccatggagtaaggactcattttataattcatatttatggggtctgtctatacttcctgggcatatttgtttctgtcctctgtcccatgctgcctgagcccagaaagcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccctcacctgaaacaaatgtgtccagaaaggattgacagttcccataaatatgaattataaaatgaacccttactctatagactagcagaaacctgatattaaaattaagcagccaaccaagcattgttttctaaaatgtcccatcttaattgaaaattttctgcagatgactgagtgaatttcttcctaagtggaacatatgttgatgactttagtccagcctgtatcataccacagcgggcatttagtacaatcataggtgctgaacaaacagctacaagccgtgaaccacagaggagaaagccaaaaggaatggattaatctgggtccttcctggttactattgctgatagttttatttaacacacagggtaaaattaaaattgaagtcttgagtgattctttctttgggcatccttgttgcatcatgctatgctcttccttcacaggcacagactgcttttgatgaaagcattaacctttcagctgttggatacttcaggtaaatactccctctgatcacatgctatggagaagaacagtggtatcttgaggaagagtttcagttcccttgcaattttggcaaacgttgactttctaccttctatttacccatggttataaagaacatttaactgctagttaatccatggttgtggttataaagaacatttaactgctagtatccagaaagacttctgttaggaaaaataggcacacaaaattcagcttaactgatgattctaatcatagtgggtggtattataaggctctctgtggttagtacttggaatactcggcagtggttgactttttgttgaaaacacgatctatctcttaagaaacaaaggtaggggaaagcaaattaaacccataagatgggtaccattttacaccttcaggattggcaaaaaagaaattggaccataaccatgttacattaagatgtgaaacaacaggaactcagtgaatctggaaaacagtttattaaattattttaatggaaagtgaaagctgtctgagagcagggtgatgtagagccttacctggtttgatcactttgccattggtgcgggacctgggcactgactgcctgtcaggaacaggcattggaagcatttttaatggccacctccaggttgcagggcagcagaggagagagggtagagagttctgcaagctgctgacccatgcttctgttttaccattatttatttgatgttcttaaagattagttaggaacagagcaggccatggagcttgatggtgagagaccagagtagagacaaagaatgggagccatgggacctgatccttcacacagaggggcaaattctggagccagaaagatagacaaagcaggcaagcatgcacctttgaaatagcgtttggtgtaaaatgaaggttgagttccccaaatctgatgatccaatattagccaaaagcagtaagatggacattcaggaagtaagaagctaacctccaggagtaaggaggcaccagtcaggagtagttagatgtttttatcagacaaagcaagttttaaaagaaaaaactaaatacttatttattcaacacatttatcgcacatacattaggtgctggcacatacattaggtacaggtatattcctgtggcttgcataaatcctcatgggtctgtttagtcatcatggtctgcaattaggggacgtgatcacttaacaacactcactgtttcttccagaggttatgagtcagacatgaactgggagaaaggcgaaggccagcccttcgaatactttgtttatggagctgcctgttccgaggttgaaatagactgcctgacgggggatcataaggtcagtaccggttggaaaggtcttcaagttgcacttaggatgcacctaaattccacagatgccatctatctgaggagagcttagtgagtggcagcatcgtgcatttggcctaagggtgatttccctggattaccagaagaaaatagaatccccacaattgccttggtgatctggttgctgccatggaaaacaactggtggcctgtctttatttccctggcccttttaaatggaatcaggaaagaaactacatgaagaaagaaacatgctctaaagggggctttcatgtagactattggcacaaccagcaattctgactttttatgagaaatgccaagatatgacattcttgaaggatttcatagacatctgtaatctgctaacaagcaccaagccagcccagggcaggtagtggccacttttttatatcttttactcagctaggtcttgccttttagaagtccagtgtgctatccattgtgccacagagctggcttggtcttgctttttagatagtttaagagcatccttatgctttcaagggatgctctgaagagatacacacacatacacacaaacacacacacacacacacacacacacactctctctctctctctctctctctccccctctttctgtctctgttgcttcaaagactcatagaatttctcctcttgtaccagagccttcgggagtaaaagaagccacttactggtcactgtcaatactaataaatgatcactgatacattaaatgggactgtgataccctaacaactgtcatgtgaccaagctaccagtttagtgataatctcttccaaaatgtacctagaagcaagctctagttcttgatatttacaaatatcctctatgcctgtgttcttggattgtgatcagatttaaattttcatttaataagtctccagcatgtattttttaaaactatagtcaacctaatctctgaaactatggtcacttttattgaacctgccttttcaagtatctaacctgtctggttctaattcagactggatctctatagggtaacctcgcactagggcaaaacagtgatcactttgagcatggtttttgtgttagactagcagccctacactactagggagcgggttcttgcatagaactgatttctgtttgtttgtttgtttgtttttgagacagaatttcactctgtcacccaggctggagtacagtggcttgatcttggcttactgcaatctctgcctcctgggtttaagtgattcttgtgcctcagcctcccaagtagctgggattacaggctgcgccaccacacccagctaatttttgtatttttagtacagacatggcttcaccatgttgcccaggctggtctcaaactcctggccttcaagtgatccacccaccttggccttccaaagtgctgggattataggcctgagccactgtgccctgcccatataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaaggcctgtttctcagccattctcctgttgatagacttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgacaggaggctcagcttctcactggctgttggccagaggcctccattctttgtcatgtggatacctctttgtaggctgcctgagtgtcctcaggacaagacaactggcttcctccagagagaccagcccaagagaaaaagagagagcatgtgcaagcgagagagtacccgagacagaagcccagctttataacctaatctcagagtgactactgtcacctctgccatagcctactggtcaaacaggctggcctggtagagtataggaggagactacatatggatgtgaataccaggaggtgaggattatccagagccatcttttaggcagcctaccacaacctagatccactctctccagtcctaacaaaagacacgacagacagcactaagcctacagctttgtgggttgtttttttctgttttgaggtggattcttgctctgttgcccaggctggagtgcagtggcatgatctcagttcactgcagcctctgcctcctgggttcaagtgattctcgtgcctcagcctcctgagtagctgggactacaggcacgtgccatcacccctggctaatttttgtatttttagtagagacggcatttcaccatgttggccaagctggtctcaaactcctggcctcaagtgatctgcccccctcggcctcccaaagtgctgggattacaggcataagccagccccaccagcctaagcacacagctttgaaagcacaaccttcactaacactgaagactttagagctcctcctctaaccttcagctgaggccacttatctcctggaaggccagtcttgctgactgatgtcaaagaggactttacattttactgtgtgtttaaataagaaatgtgagttcctgaagttttattattgtcaaacattccagatcattatctaattttcaaatgttacatgaaagtcccagatcaaataaggaaactcttggatttcttttgttcaattagtaattataagaacaatctgttagtcatggcagagaccattatatcacattaaaaaaaatgtacagacttgctggaaagcaaaggtgttactaacactctggctgggcctgctgtacttctcctcatttgtaggttatcagtagcaagttgtagtgtcaactttattctcttctctgctacaaaaatgaaaagtctagaacagcagatgacaatttgaagacttttttgttggtgcaccctgaactctgtggttcagtaaacattcctcagccagttgtacctggatgtttggttgtatgctagccattaagctttgcaactaggatcgtgagggccatagatgttttcttttgttgtgtcatatgttatatctgttgtagtgaattaaactcaatctgttgcatcatacagcttgaatcaaaatgaagtaaatatttttttctcctattatttccaagaaaaaaagacagtgcttcagctggctaagagtatttgtataattttgaaagttttacataataaactttgtcctataataaaatctttgttgcttctttcgaaatgacatggctgaaagaaaggctttataccaaagtcagcctggcaggaagtgttcctcagcttcttctccctaagttattctcattaaaataaacattttaacttttttttaatactagaacatcagaacagacattgtcatggatgttggctgcagtataaatccagccattgacataggccaggtacgtgtaactgatgtgtctcactttctatttgtaaaagccaaaagtgcggtggggtctgcaggagagcattccatcagtcttattcatcatcttatttttctaaccctttagtcaactctattcagaccaactgcagagctcaaatgttttactgtttaaaagggggaaggaaataaaggtgttttaggtagtttttgaagaaacataaaatctgtgactagggagcttgaatgaggcaagaccaagcctacaggtgactgatgagctccaaacttctgggacataaatagagttagtgcccagtgctgagccttagccacacgatgggcttcagcttcgaggagtttgaagtcgtgttgggataacaagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgacacaggacccacctggaatcttcatatactgggtttgcgtgtctcgaacctggaggcaattcagctcattacctctgatttagggcaccatcttgtgtcccctcccccccaccccccgcccccaccatcatgacattgcattattggcgaatgggaagaatctgtggtgtggagaagtcaaaggaggcttagggaggaagtgggtgtgaaccaggttgtcaaggaaagaatgagaaacgacattaggggtgaaagaagagtggaggaagtcaccctacagaaacacatggaatttagcatgcctgttcatggctgctaatcaggccagggcagatgactatggggaaggcctgtgtgggaggggtgggccatgaggagggagtcagagagcagaagagggctggggactgccaggggtgggtggagggcttttagagacaagacttcacttagtggggatggactgaagtgtttggaagactgatctaaaatcagagtccagagatgtgaggctagccactttgtgggcaaggaggtgggatgagacaatgggattgtagcattcactagcaccctggggtctctggacacatcagtcaggggggtttgtctgcctcatgggcaaaaaacaaaagaagagggtgcttgggctccagactctgtgaagactcttcctgagcactcatttcaatggccaaaccaaaattagaaccctagtcctttgtctttgaccttctttttttcatgatttttatttattattattattattttttttttttgagactaagttttgctcttgttgcccgggctggagtgcaatggtgcaatctcagctcaccgcaacctccgcctcccaggttcaagcgattctcctgcctcagcctcccgagtagctggaattataggcatgcaccatcacacccagctaattttttttgtatttttagtagagacgggatttctctatgttagtcaggctggtctcaaactcccaacctcaggtgatccgcctgcctcggcctcccaaagtgctgggattacaggtgtgagccaccacgcccggctgactttgaacttcttttaacttaatgctgaacaaacatgtttaaaatggcttttagataaactttcagcaacatgctccaagacaccctgaaaatgctcttaaactgtaattttaaaattcaagcaaacagcatgaagttgaaatgctacttagtgttgactgtgttttctcatacgtggaaattctttttttgttcttgcctcagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaaggtaagtaatgttctatgggtaaatatgcatgtttatatgatacctgttgggtgacaggaaggctacattcctctcttggctgtttgggatttttaccaggattgcagaagaaaaattcttattaaacattttaattctaatctaacattatgataaaaatttttagtattccaaatcttagaacttaacatcaactactattgccatcaggttctatctaatttttcaccttgcaataatcatcttcatgcctaataatcatcttctgtatgtaggtcatttcctgaggctagaattctaagaatgggaatattggatcaaaagattaaattactttttgaaacaaaaaatttatataggccgggcgcagtggctcatgcctataatccaagcactttgggaggccaaggcgggcagatcacctgagtccaagagttcgagaccagcctggccaacctagtgaaaccccatctctgctaaaaatacaaaaaaatagccaggtgtggcggtgcatgtctataatcccagctacttggaggctgaggcaggagaatggctcaaacctgggaggcggaggttgcagtgagctgagattgtgtcactacactccagtgtcatgcttgggcaacagagccagactctgtctcaaaaaaaaaaaaatgtacatatgtagtacgtaatatttttatatatgcacatatgctataaatatgcacatatatacagagtgagagagagaggtataatctagttggcatgcttcctttcaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatggtacgtttgcatggtagaaaaaaaatagtgatcataaaattctgaatttttggcctctgttcttgtggtaagttttcgtgaacgcactgctgtggcttttcttgccagaaaaggtgacgggaaacctgggggcatttgagcagatgtgcagaggggtccttgaacttgtacccctcgggttgcattttttcatcagcctgcccctgcttggctccattctatactatttgacaaaagaaagttcattcccattagttttatgttcctctcctgttttgctcccttcctaggacaccttggtcaggaatagaagttcaggaactatgccctgaacctaggacacccagtccaggaatataggcccctctgacagtctgcctccaccccaaccccaaacgggcacccggaaagtatgctagcaggaacccctcccctctggcaacagcgcccatgccgagcagacatctctaccctccttggatattttcagggacagggtttttaattgtggaagaaagtcatactgttcacagttaccaccctgactttgactgaagggaaagcccctcccatcctccactcacactggctctttgtggtatccttcatggttttccctaagcccctgacacgttgctttttctactctggagaaacagagacccactccacttttcactgggtggtcttcaagcgtgagatgataaccccaggacctctccagtcctcccctggcttcctctatacttcacaggctgttgttccctgacctgtcatggccctggttgccctctgctggtgtttaacctactttatgttcttctatttttcacctaagtcacaaacatttcccaggtttgaacatccagatttgtttttattttagattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatatccgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaa

SEQ ID NO: 2 - DNA, 37557 bp, Homo sapiens
  misc_feature (1)..(37557): DNA nucleotide sequence of the entire C1orf114 genomic locus including 5000-bp upstream sequence.
tatttcttcaaattatcatactacttctttctcttttctcaaggactcccacaatgcagactgtggtccatttggtggtgttctacaggtcccctaggctctcttcacttttaactttttaatttttttgtttctcagatacaacaatttcaattgtcttatctttaagttcactgattctttcttctgcctgaccaaatatgcttttgaatcccaacagtaagattttcatttcagttgtacttttcagctctagaatttctttgatttcttttttagttttcaatttattgatatttccattttgtttatatattattttcttcactttctccacatctttccttagttatttgagcatctttatgatttaaggtcttctcaggtatttttctgagtttatgcctttctctgggtgttcaatttaactttatacttttctctgtaaatgtagttgctttttaatgtcttagtctttaatgtttgtcttccaaaaggaagaaaacaaggaaaattccctggaagttgcttcagctggaggagtaaaagcttacaatggtgggggaaggtgcaacaacaatggcggctacctctgtgtttgcatctccttgatcagaagcagtaatcaattatcagaacatagaccctcatcaataggaggacagggtccttactgctcattgactctcatgaactatgttaaagctgctcctgcaagtaatacagactgcctgctagggagctggggtttggggttgggtagatgatactgaactaagagctgaaattcaccaaaataagttcagttttctgtccaagccttcccttgaaagttgcaagcctttaatagactccacagttccaaaatagttacaagagataggttttgacagtgcaattgtttttccaggtggggagatagattcctggtgcttcctattccaccatctttttagaatcctccagcagtacttcatttatttttattgcagaataatattccattgtatagatatataacatttatccattcatcatttgatggacatttgagtcatttccacttttggctaccaatcatgctgctatatcccaaccaggcaagagaaagaaataaagggcatccacattggtaaagaggaaatcaaactgttgctgtttgtcagtgacataatcatatactagaaaaccatccaaaaagattctagaactgataaattaattcagtaaagtttcaggatataaaatcaatgtacacaaatcagtagtgaggcaggagaatagggtctggagtcagtgaacctaaggccatttcacactgacttcctagaatgcagttgaaaggaaaaccctaacttgccatgtttaagtaacaaaaggaccagaggctacttccttggcaaatcctctttcctgcagatgggaaattgaaagtacccctgattggttgcaaagagcataggagtgtaatgtttgcataggagtgtaactttgtaacttcacttcaacctctgattggttgctttccacaaccaatcagactgattgcgggccaccacttcatttacatggggtgaaccaatgtaaagtgtccaatgggaaacctctagtgggtatttggacccaagaagattctgtatctggagcccttgagccactgctcatgcctgttgccacattgtggagtgtactttcattttcaataaaaatctctgcttttgttgcttcattctttccttgctttatttgtgtgtttttttttttccaattctttgttcaaaataccaagaacatggacaccctccaccggtaacagtagcactgctgtataccaacatcaaccaagatgagaatcaaatcaagaactcaaccccattacaatagctgcaaaaaataaaatacttaggaatatacctaaccaaggaggtgaaagatctctacaaggaaaactaaaaaacactgatgaaagaaatcatagatgacacaaacaaatggaagcaaatcccatgctcatagatgggtagaatcactattgtgaaaatgactatactgccaaaagcagtctacaaactcaatgcaattcccatcaaaataccattatcattcttcacagaactagaaaaaacaaccctcaaattcatataaaaccaaaaaggagcctgcagagccaaaggaaaactaagcaagaagaacaaatctggaggcattacattacccaacttcaaactatactacaaggctatagtcactaaaacatcatggtactggcataaaaacaggcacatagactaatgaaacagaatagagaaccaagaaatgaagctaactgatctctgacaaagcacacacaaatataaagtgaggaaaggacaccatattcaacaaatggtgctgggataattggcaagcaacatgtagaaaaatgaaactggatcctcatctctcaccttatacaaaaatcaactcaagatggatcaaatacttaaatctaagacctgaaaccataaaaattctagaagatagcattggaaaaacccttctagacattggcgttggcaaagacttcatgaccaagaatctaaaagcaaacgcaacaaaaacaaaggtaagtagatgggacttaattaaactaaaaagcttctgcatagcaaaagaaataatcagcagagtaaacagacaacccacagagtgggagaaaatcttcacaaactatgcatctaactaaggactaatatccacaatcttcaaggaactcaaacaaatcagcaaggaaaaaacgaataagctcatcaaaaagtgggctaaggacatgaatagacaattctcaaaataagatattcaaatggccaataaagagatgaaaaaatgctcaacatcactaatgatcagggaaatgcaaatcaaaacctcaatacgataccaccttactcctgcaagaatggtcataagcaaaaaataaaaaaaacaacagatgttggcatggatgtggtgaacagggaacacttttatactggtgatgggaatgtaaactagtacaatcactatggaaaacagtgtggagattctttaaagaactaaaagtagatctaccatttgatgcagcaatcccactaccgtgtatctacccagaggaaaagaagtcattatgtgaaaaagacacttgcacatgtttatcgcagcacaattcgcaattacaaaaataaagaaccaaaccaaatgcccatcaaccaacgagtggataaagaaaatgtggtacatatacataccatggaatactactcagtcatatgaaggaatgaaattgtggcatcgtagctacctggatggaaatggaggttatttcatcattattctaagtgaagtaactcaggaatggaaaaccaaacatcatatgttctcacttgtaagtgggagctaagctatgaggatgcaaaggcgtaaagatgatacagtggactttggggacttgggagaaagggtgggagcaggatgaggcataaaaaaactacatattggttaagaggcccaggtgggcagactgcctgagctcagttgttggagaacagcttgggcaacatggtgaaaacccatctctactaaaaatacaaaaacttagccaggtgtggtggcgtgcctgtagtttcagctactctgggggctaaggcacaagaatcgcttgaacccgggagatggaggttgaagtgagcccagatcgtgccacttcactccagcctgggtgacagagcgagactctgtctcaaaaacaaaacaaacaaacaaagaaacaaacaaaaaaactctacatattgggtacagtgtacactgctcaggtgatgggtgcaccaaaatctcagaaatcaccgctaaagaacttatccatgtaaccaaacaccacctgttcccccaaaacctgatacttaaaaaaaaagctgctatcacccattatttgaaaaatacaaatttaggaggatggtcagaggaaaaaactattaacctaggagttctgaaacctagggtctacttccagctttggtaagtaactctacaactctacatccattaaaggagatttgactaaaattccttcaacctttagcagtgaataaccttttttgggagcgtcttttttcaagcgctgaagcagtagcaacattaggtcattacaactacaccacatctaggaagtgcactcaatattacaattcattttaaccttccattttaaaagaccttaagtctataacttgaagaatatctaaaaatttaattttacattgcctctcttggagaaaaggtgctctccatcacatcaagtgatagaaatcctaataataaacaatttaaaaataatccgaacacactggattgtactgaggaaatatttttacttctcccagttcttatttatttctggctgggaatggatagttgttaaaatcatctcaactttcaccacaatctaaattcatcttgctttgcctttatacataaagataagcagaatttgagaaaattctagttgaccattttgacatgcctcaaagctagagcaaaaatcctattttctttggcaactctcttgggtaaagttttggttttgattaggaaaaaaagaagctgagggtcaaaaatatggtaactcattagcaatttgcttatctactaatgaaaactaaaaactacttttctacgttaactgtgaagcacataacatatagaaatatagttttagaagttgtcctaagaaattctaaatctgacgagagacagctacaagagggaaatttcacaaccaacacagcggcacttcgcgagtctctataacgttagtgatgcgtggattccttagtcgtccccttagaaacctcagcttcactggcccttcgcaagcaccgggatgggtgccgggaggggtcggtggtctgaggatattgcatgcgcctgcgcagatttttgtcgctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacaggcaagagggatatagagggagagaagggaaggacgatgcggagatgttaatggtgggatagagggtaaaggtataaacgtctggtatagctgggagggagggtaggtagtgagggaagaagctttctggtggcgccttatcctctggagtccgaggtccaccgagtctggcactggtggggaagtctggtaacacctttcttcactatgtatgaaggatactcgtctgagagtagcttagactaaatttttgtcatattctttcccctctcaaagttcttgaacgtggaaagtaataattttgtccctgggagaaaaagtcactcccgaaattgtagcttccatgaggaggcaatggtattcatttcgttggtggtaccttgggatcctgaatacagattaaaattatcacctaaagtccataaaatatttatcatcatactttgtgacagtttatgattttttaaaaacttacttataggatcacagtcttggcaggatacacaggaataatgggccagatggtttcatgatgtatggattagtttttgcttaagtacttactttatattaaaaggcattctctttgacatgctttcagttcttagatttttaagcaagcatatgtttaaaacgctgtaagatgggacccaattatttaaactatttttgaatatcctgaattctggaagaaagttatcaaaattatgtatacatgtggacttggtttaagactcctactgaaagatcggcagttcacctatccacatgggatttaccagacactcagggaggaaggaatttatttccgtctcttactacagttccgtattaagagggtagagctggtctaagccgtttacctagatttttactgatgataaatgttgaaatttaaatgtgtgaaactcacaagcataaagtaggaagtgttaagtgattttgtttgtataagatgtatttttgttctagcttgttgattctgtaccatatggacagtaccctggtgatgaagattaaaagaattgaaggggttgaatatcctgtgacgcatttgaaaaaggcttaagggatttgataaccagagtttgtaatttatgttctttgtttacttgagaaccggccatgagggtgtttttttgtttttaagttacaacaaaagaattgcacttcagatttgatgtgacttaatttacttctcagagttaccttaactatggcttttttttcctttgaattatggcataatagtatgacttaaagacccctaacctgttaaatttttaattactgtgcttttattatacagattttatgttttcattttaaattttagttttcatgtgtgtgtgattctctgtaaacaataaaacatatctactaaagtcttcaggcaaccatttatttataagttcagaactatgtttatcataaaataagggaaagcactgaagagttccaaagaaatattcttataatatttatgtaactcaaacatcttaaaataataaatttcaagatccctgctctgaaaagaaaactgattattccaaggcattgtgactgtgaaaagtactatttttactgtaagtatttcggattacagtgagttttattctgtatcattcatggtgcccttgcttttaattggtaggtagttagatataatagcttaagcaatttagcttgtcttgcagttaggaagtgaaactcactctgaagtgttgacttgatttctccagatcacttcaaaatttgtgctcaacctgatttagaaattattgaagggcttacttttgagtcctttagcaaatctattttgtgtttttagtttaaaataaataagtatctagaaagaattatagtccaatgaatagtttagaaaaaaacaataattatccagttgaacaattaacagttatttttgaataataattaagttgaataacagttattattcagtaataacttagtctggccaaaggtttggggagaacaaagcgaagctaatggctaaaacagctggtggattatttattaattcagcatacctaaagtgtaccaaaaattaactttatcttgagagggaaaaggaaccaacatcaataactatttggggaacagggggaaggtgggagagtttttaggaatgtttacctatggaaatgtcttgccattgcagatctctctttcatggtgtattcaagtgcatgttcattttgaacattctattttgtgtttctctgtgttaattagcttacctacagcattaatctccatactccattcctcctctagagtgggcataacatataccttatcttttaaaatcttacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagaggtatatattgccaacagcattcataataattatattacaaagtgctttgcaattctttaaggttttcacattattatctcatctaaacatcacaaaatttctttgatctacattgggcaaattactattatcctcatcttaaagataagaaaaatgaggcgtagattgcttaaatgttgtatcctaaggcatagggcaggttagtgagagaacagttattacgctagcatttaataaactaaagtgaccattataaaattataatttaaataatataaataaatagtaaaatcatgatttattgcatcgaaagtaaaaaatacagttaattcctactttctgtgaacttgggtaaaatcatggggttatgctattaaaataaatgaaaaataaagcaaatcctctaaacacatgaccttttagctaatatttaaaactttaagactgaattagctcttcttggcaatgaatatagagaacaaagtaaagggtcaaagtctgagtcacaggaatactcctaggaaaagtggatgcattaagcatggtcatatactatttatcagagatgaagaaaggaactccaggaaaattaaccagttcctgcatcaaggtaggttatttctctctctctttacatgtgtataatgtgtatatgtatttctgtaaaacatatatatgtatatatgcatatgtatgtgtgtatatatatgtatatacataagttagtgtcaataagtagaaaaaggaataacactaggatataaataggtgactttggagggataatgatcagagttatagcagaagccagttttaaaggtgttaaggaaaagactatgaggaaatgcaggttttatattacagatttcttagttccattttgctttcttatataatggaaaagacaaatggaatacacaatgtttgaagatggaaacagagtcaaaagtgaagatttttctaagatggcttttaaatgggagttttatgcatcctaacagaaaaataagcagaatgagtagaggcagatacccagagtggtaaggttgaaccaatttctcaagactggaagggtgtgagatccaaagcacagtgcgatagaattagagaggtaatagggatgatttattgttttattttctaattcaacaagtattaatgatcacctatcatatcagaggctgttctaggtgctagggatatatatagcaggaataaaataaaagtgctgttatgaatcttacacattccagcggatgattataacaacctcttcttttgaggcttttgggaaaaggggatgactgagctagagacacataagagggtcaggggaagatttttttgtaaaaagtgggttttcaaaagaaaagaaaagaaaagctaaaggagagttcagaaacagagactataagaatgaaccagagatctgccatcctcatgatattggaaaaataaaaaagagtcaactagagaaacaaataaggctaaaatgaacacttgtgatacagagctcttagttaaatcatagttatttggcagtcatttaaatgggccaggtttatttgcttattagacatctgactatcagacaagatgaccttcactatcacacaggatgacctatgagcaaatgaaggaggaaagtgattttaaggggttgaagagagaagcatgtagtagctcccatagaactgctttaggagggagagaactttgacaaagagaaaaaatatatatatatataaaatatttatatacatttatatattatatctattatatttttatatatataagcttttagttagatacagcagaagtggagttttgtgctgcactgatactggtttatggttcatgtggaattaactttttttaatttaaggccaagttatctgatggtggttagcatggatttctgaaatctctgagtatagttgaagaagggaaatctgatctagaggtaaaaattgacctggaatttagataggtcctgcagattatagtgataataatagtctgaaaagattaaaagaacctcaagtgattaggacctgaccaaataattcatccttgaaatggtctggggagaaagctgtttgattgaagaatgcaaatattacaaggaggaaagatttttgaaaattgtttttctgaaaatgtaaagagaggaaaattttataggggaaggaatattaatattgttatttgtagttaccttttgatacattagcataaaaatgtttaaaaatcaatgtagcacttagctacatcaaattcaaatttaaagttgaatttttcctgcattgctgtcacattatttcccttggatactcataagtatgaattagaatgttatgagcaaattatgagcaataaacacttaaattttcccattcataaaataaattacatgaacaggaaaaatcccattttgtatgtctacttataaatgaagaatctcaattttgactgaaaaatatcttgtttttagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggtgagaacctaagtgggcattatattaaaagtagagtatgttttactgttttataaatgcaatgggaattaaaacagttgttcaaaccattggagactttttttgattgctttatttatctattgttagattgattaagtgttaagaatgtgcatttatggaatgaacacagtgattactttggtccttgtaaggatcacaaagaatagtagactgatctgtgttagcggagatctcagtgatgacttcatctgatcctttcattttaaaggtgagactcatgagacgttaagtgactgctgaaagtaatcttgatatgataggtaaaaataaaatgtcagatggaaaaatgaaggcataaagtgtagaggtttaggaggcaacaggaagacttggactataattcttttatttgcatgtgtttcatgttatgttctatgcttacaattcttttatttccaggagtttagtttcagattaagaatatagcctaatattcttaacgaaatgtctccaaaatgccatatagaatcccaaattaattttttttgtttttcatatttgttcttatgtgaaactctatgtatcttataattgaaaattccaggacttaaactggtgagttttctcagaattacttatgtcagtgctccaattctttgttttactggaaacctaatggtattaagctgagccatacaaaatgtctaattctaaatacaaagctcagcagataatacatgagaagtgaccttacagatcattttgcagataagaaaaccttagaaagtttaaataactttaccaaggtatatctgtacttgttagtagcaaactggaataaaaatttccagttctctggcacccttgagaaatggtgtgttatctactttatatgggaaattatcagggaaatatctggcatttaaatcaggaattggcattagcaaaaaaaaaaaaaaaaagtgaaacatgacttcgtaagaacgtgtaacctctagcacactcagataagaacctaaaagggtgcaagcttatagagcttcgttcacttggtcactaatagctctaatagtcaaactaagtttacttgattcaggtataaaaacacttgaaagtataggaatttggtgacaatacaaaataattttttgagaatgacatctatatgtttgctatacacaaatgtgtaggtatgtgtatatttttacaaaagttatacaggtgattttatatagttgtcactgcctttttattaatgaactgatgttagtctttaactggtgtgaaggatggataattctgttttcatttggattctcttttctgaatgtcacacactctttgttctgaaatacacttttattgtatcctataactaacttggctcaaggcatggtcttcaagtactaaggcttttaacatgttttagttggtttcaggggaaggctttgcttttttatgcccatattttctgggttgggctgctatactctgtctttctaacctaagtgcatcatttcagtgttctctttggcaactccgttatcagtgctttggctgatagcttctgtgtaatatacctgaatgttccccttggaaagataatcatcgtttgtcatactgtattcatgcaaggcatccaaagtcctttgtgtgaaatggaaatgtataaataatgtaaaatttaattcttaataaattcatttatatttcctataatacaggctactttagggctcagaaaatagtatataggtattctcaaatatattttatgctgtttggtagaattttcctttcctcccttccttctgttcaatcaaaaggaattagaaagtcttgctatattgtcaaaatgtaaggaaaacacttagaattccattatttgaagaaaattttactatgaacttgttaaattagcccagctaatttttgtattttgggtagagatgggttttcaccatgttggccagtctggtctcgaactcctgacctcaagtgatctgcctgcctcggccccccagagtgctgggattacaggcatgagccaccgtgtctggcctagaaggaccagttttctgatggaaagttttagggtcagggaatcctaatttcagatctcaaaatatatctctctactctgataactcatacaattttattaatcttccattaatgtcttttcatattcttttactaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagtaagtaaaacttctctgaaaaataagttcatacagatatgaaagctgaacttatttatagaagggagtctggatatcagactaacagcctatggaagaagtagaaaagttgttcaagaactacccttgcaaaagatgcaacatgcagataactacaattaggttctaagaggtcttgtgaaaataaaatgattcctattttgttcagactttgatggaacagaaaacagaaaactatcaattcgttttttcaaggtgtaactttgttattcaaacagggcaaagatacacacacacccccccacaaaaccctagagactggtctcacttaagactagacgtatagaaatattatgtaaatctttagcaaattaaagacaccaaattatttaatttaaaagaattaaaaaaactaaaacagaaaatagagaaaatttaaaaatcattcatattcttactaaaaaaagatatatatgtaaagttgaaagtataataataataaaatttaaaaaaaaagaaaaaaagaaaatttaaccctaagctcctccaggctcatctccagtgataaccacttttaacagcgtggtgcaaatccttttatatcttatttatatttatatatttacatgtcaaaagttttattcagttttttttcacttcatcatggaactctttctaagccattacatttaaatctctctttttcaaatagctgcatggtattacagtgttaatttattaagccattcttcatttgtagatatttaggttggttccaatgttgcgttagttaacagtgctgtagtgaagaggtacattctatgggaacatcagtaatctgtaggagaagttcttcagaggtgaatttaaaatgtttgaaggcttagagtgaaatgtttcgttaaagatgcaaaagtaacctcccaaaagataatatgaatttatagttcctccaacagtgtgtgagagtaaatgttatacctgttcctccaacggtgtgtgagagtgaatgactaacactgtatgtgggttatcatcttatttttccttcaaattaataatatacatgcttgtatatgagcatgtgtgagaaataataagagatagatataggtctctacccctagtttttggcacacagctcctaaaacctttttaatttcttgagtgatgggggttctacatgtatctcttgttctaataactgagcttttatcctggcttctgacaaacagctgctaattccttggaacttcttaggtgataggactctctttgttctaataagatgactcttggtgggctcctggttaggtgctggctgccagaaagactaagccatgattagaagcccggaactttcagttctaactcctttcttctaggaagggggaaggggctagagattgagttaataatctcaataactatgtgatgaagcctttataaaaatccccaagctgcagggttcagagagcttctagggtatgggaaatgtggtgttgggggggtggtgtgcccccaagagggcatggaagcttcacaccccttcccaaatactttgccttgtgtagctcttcatctgtgtcttttattatattctttattaataaacttgtaaatgtgtttcctcgagttatgtgagttgctctagcaaattaatcaaacctgaggagagggtcatgttcccaccactccccaccctggcaatatatagctggtcagacagaagctctggtcacaatctaggcttttgattgatatctgaagtggaggcaatcttgagggattgagcccttaacccatgggatttgatgctaactccagggatatattatcagaatcggattaaattgtaggatacccagctggtgttaaacttgtcagtgtgggaagtgggaacccttccccattttggtaaccagaggtgaagtattctgtgttgagtgtgaatgagaaggaaaaccaattggtttttctatttatatagcgtgtgtattattctgtgaatttcctgtttataatctttttccttttttagtttggtttttattatctaagtggtatatgagagattttgatcctttgtctattatatatgttatatattttcctagtctgacaatatattttttgttacagtgtttattatgccatttgtggaagtttttagctttttaaaatcttgggatgggcagtactttcacaggcaaggcagaaaaaacataaactaaaagaggaaatatggagaaatttgactgataccatatagtaaaataataatacactgagtaagatttaggaaggaaattatggatcagtaataacatgtactaatatcattcatcacatcagtaagtagataaaagaatattatcttgaaagatatagcaaaggtataatttctttttaaaaattcctaataaaatgcggataataaacactataatggggaaatactctaggcatacctgttacaatcagaaacatgtaaggttctatattaaataactgtattctggtgtttcaatccaattcattaagaaaaggaaatgaggtaaaaataataggagtgacggggccaagatggctgactagaagcaggggggctcagaggctcctatcggaaaaaaacataataagcatgtgaatccttcactggcaaccaaggtatccaggttctctcatcaaacttgactagaaggctggcgtgacccatggacagaaggaagagcagtgtagtgcgtggcccacctgagagctacatgggaaaggagaaccccctacccccagcaaagggaggcagtgaatgagcacgctacccagaaggggaaactgtgctttttccacagaactgtgcaacccatggatcagaagatcccactagaaaatctaggccactggggcctagcgtcccaaccctagaacacgattcttacagcttctcagctggaatctacttaagcctactgaaaactcctcgtgggaggggtgaccaatttaagttgttgagtttcaggtatgcacaaaatatccagatgaagatattgaagattagttggagaaatttatccggttttcaggagaaaagttgggactggagataggaaattagcgatttcagaggtggagtagtttgtgtgatgaggatatggccatagaaatacgtggcaagtgtaatggagaaagacgtagaagatgagagaatcaaaggtctttgggggtggatgttcaatggctcttctatgtagttaaaaatataccttgggactggcatggagaggaatattgagtcaggagtgatcagaggtggttacataactatttttaatagagccaaatgatacaaatgtcaaaggaggatgggttttctcaggaaaacagaaatacaattcagaagacgtatgggggaatgaagagaatattaatttatttgtctgaccaccgaagtacttgaagtatggtagaaaatgcagcctctgtttcagagaagatgtggcttgggggagaatcagaatttgcataagataggaaatttagggccagatccctttcagtgacttgggaggatggatgttgtttgggagtttttatatcattgagtaggaattacagagaactaacaagggttatgaaggacaggaggaatttgggattgggtgaagaagcagcacagcatattgctgtagtgattacaggtatagaagacaagaggagtttatgtttcagtcagtgaccacggaaaacacagctatggccatactgctgatagcttcttggacgatgatgggccttcaggcctcatggcattccaagtattataattttttaaatggggtatttgcaaaaataaatgtacagtatattgtgcaatatttgcacataattgtgctgtatttgtacatagtaaatagtaatcttggattgtattctcagaaaacatgagtcatattgaacataatttatttcaaaaaattttatgtagaagacatcatggttatatatttccctttgaatatttattttgaatatgtagtattttttgctacatttcaagtttgtctcaaaaatatattttaatgagaaatagtatcacaaactaatagtattctgaagtacttttatgagctttgtctctactcaagctgaaatatagcacaatttggtagttgattaatttggcttattaatacattgctataataagtgcattatgttgattatttctgtgggacattgtgtataatgtgagtcatagtttccagaaaatatctttagatttatagattgtggaatgaccttttttacattagatggataaaagatcttaggtgatgtaatttttattgccatttttaggaaaaatagctaaaaatgtctttccaacgttgttttgaaatttgcttctcttgctcagtgatatatatgtatacacacacatgaaaatgtatgtatgtatatagtctatctatgttaaccgtccatgggtacttgtataccttgtgtattctgcattggatgtagtgctgtattaatgtcaatatagtctagttggttgatagtgttgttaagatcttctgcatgcttattgtcttcccccatttttcctatgaattacttagaaaatagtgttaataatttcatctatcattgtgcccttgcctatttctcctttggttctgttgagttttgcttcatgtattttcaagtgttgtgggtatacatttaggactttatgtcttcctgataatgaccttttcccattatgaaatgtccctcatatcctgaagtctgttttggctgaggttaatgtagccacatcagtgttgttatgcttaccatttgcatggtataacttttttcatattttactttcaatgtatctgtggctttatatttaaaatggcttgtgcagacgtcatatatttgaatcttccagtccagcagtccactccttatacttagtattcacttgtatttaattattttttttaattatattttaagttctgggatacgtgtgcagaaagtgcaggtttgttacataagtagacacgtgccatggtgatttgctgtacccatcaacccgtcatctacattaggtatttctcctaatgctatccctcccctagccccccaccctccgacaggccccagtgtgtgatgttcccctccctgtgtccatgtgttctcattgttcaacttccacttatgagtgagaacatgcagtgtttggttttctattcctgtgttagtttgttgagaatgatggcttccagcttcattgatgtccctgcaaaggacatgaactcatccttttttatagctgcatactattccatggtatataactgccacattttctttctccagtctgtcatttatgggcatttgggttggtttcaagtatttgttattgtgaatagtgcctcaataaacatacatgtgcatgtgtctttatagtagaataatttataatccttcgggtatataatccagtaatgggattgctgggtcaaatggtatttctggttctagagccttgaggaatcaccacactgtcttccacagtggttgaactaatttacactcccaccaacactgtaaaagaattcctatttctccacatcctctccagcatctattgtttcctgactttttaatgatcgccattctaactggtgggagatggtatctcattgtggttttgatttgcatttctctaataccagtgatgatgacctttctttcatatgtctattggctgcataaatgtcttcttagagaattgtctgttcatatcctttgcccactttttgatggggttgtttgttttttgttgtaaatttaagttccttgtagattctggatattagccctttgtctagtggatagattgcaaaaattttctcccattctgtaggtcgcctgttcactctgatgatagtttcttttgctgtgcagaagctctttagtttaattagatcccatttgtcaatgttggcttttgttgccattgctgttggtgttttagtcataaagtctttgcccatgcctgtgtcctgaatggtattgcctaggttttcttctagggtttttatggttttaggtcttctgtttaaatctttaatccatcttgagttaatttttgtataagatgtaaggaaggggtacagtttcagttttctgcatatggctagccagttttcccagcaccatttattaaataaggaatcctttccccatttcttgtttttgtcaggtttgtcgaagatcaggtggttgtagatgggtggcattatttctgagtcctctgttctgttccactggtctatatatctgttttggtaccagtaccatgctgtttgggttactgtacccttgtagtatagtttgaagtcaggtccatgatgcctccagctttgttctttttgctttagattatcttggctatgcaggctctttttttgttccatatgaactttaaagaagttttttctaattctgtgaagaacgtcaatggtagcttgatggggatagcattgaatcagtaaattactttgggcagtatggccattttcataatattgattcttcctgtccatgagcatggaatgtttttccatttgtttgtgtcatctcttatttccttgagtggtggtttgtaggtctccttgaagaggtccttcacatcccttgtaagttgtattgctaggtattttattctctttgtagcaatgtgaatgggaattcactcatgatttggctctgtttgtactactgctgtatcgtaatgcttgttatttttgcacgttgattttgtatcctgagactttgctgaagttgcttatcagcttaaggagattttgggctaagatgatggggttttctaaacatacaataatatcatctgcaaacagagacaatttgacttcctctcttcctacttgaataccctgtatttctttctcttgcctgattgccctggccagaacttccaatactatgttgaataggagtggtgagagagggcatccttgtcttatgccagttttcaaagggaatgcttccagcttttgcccattcagtatgatattggctatggatttgtcataaatagctcttattattttgagatacgtgccatcagtacctagtttattgagagtttttagcatgaagtgctgttgaattttatcgaaggccttttctgcaactattgagataattgtgtggtttttgtcattgtttctgtttatatgatggattatgtttatcgatttgcatatgttgaaccagccttgcatcccagggatgaagttgacttgatgttgaactttttcatgtgctgctggatttggtttgctggtattttattgcgaattttcacattgatgttcatcagggatattggcttgaaattttcttttcttgtgtctctgccaggctttggtatcaggatgatgctggcctcataaaataagttaggtaggagtccctctttttctgttgtttggaatagtttcagaagtaatggtaccagctcctctttgtactgctgatagaattcagctgtgaatctgtctggtccttggctttttttggttggtaggctattaattactgcctcaatttcagaacttgttattggtctatacagagatttgacttatttctggtttagtcttgggagggtgtatgtgtccaggaatttatccatttcttctagactttctagtttatttgcataaaggtgtttatactattatatgatggtagtttctatttctgtgaaatcagtggtgatatcccctttatcatttttttattgtgtctatttgattcttctctcttttattctttattagtctggatagcggtctatgtattttgttaatcttttcaaaaaaccagctcctggattgattttttgaagggtttttcatttgtctatctccttcatttctgctctgatcttagttatttcttgctttctgctagcttttgaatgtgtttgctcttgcttctctagttcttttaattgcgatgttaaaatgttgattttagatgtttcccgctttctcctgtgggcatttagtgctgtaaatttctctttaaacactgctttagctgtatcctagagatctggtacattgtgtctttgttctcattggtttcaaagaacttatttatttctcccttaatttcgttatttacccagtagtcattcaggagcaggttgttcagtttccatgtagttgtgcagttttgagtgagtttcttaatcctgagttctaatttgattgcactgtggtctgagagactgtttgttatgatttgcattcttttgcatttgctgaggagtgttttacttcccatatgtggtcaattttagaataagtgcaatgtgatgctgagaagaatgtatattttattgatttaaggtggagagttctatagatgtctattaggtccgcttggtccagagctgagttcaagtcctgaatatccttgttaattttctgtcttgtcgatctgtctaatattgacagcagggtgttaaagtctcccactattattgtgtgggtgtctaagtctctttataggtctctaagggcttgctttatgcatctgggtgctcctgtattgggtgcatatatatttaggatagttagctcttcttgttgcattgatccctttacgattatgtaatgcccttctttgtcttttttgatctttgttggtttaaagtatgttttatcagagactagtattgcaacccctgcttttttttttttttttgctttccatttgcttggtaaatgttcctccatccctttattttgagcctatgtgtgtctctgcatatgagatgtgtctcctgaatacagcacacctatgggtcttgactctatccgatttgccagtctgtgtctcttaattggggcatttatcccgtttacagtaaaggtcaatattgttatgtgtgaatttgatcctgtcattatgatgctagttggttattttgcctgttagttgatgcagtttcttcatagtgtcaatggtctttacaattggcatgtttcggcagtggttggtatctgtttttcctttacatatttagtccttccttcaggagctcttgtaaggcaggcctggtggtgacaaaatctctcagcatttgcttgtctgtaaaggattttatttctccttcacttatgaagcttagtttggctggatatgaaattctgggttgaaaattctttaagaatgttgaatattgggcccctactctcttctggcttgtagggtttctgcagagagatctgctcttagtctgatgagcttccctttataagtaacccgacctttctctctggctgcccttaacatttttttcttcatttcaaacttggtgaatctggcgattatgtgtcttggtgttgttcttcttgaggagtatctttgtggtgttctctgtatttcctaaatttgaatgtttgcctgccttggtaggttggggaagttctcctgggtaatatcctgaagagtgttttccaacttggttccattctctctgtcactttcaggtacaccaatcaaacgtaggtttggtcttttcacatagttccatatttcttggaggccaagtttgttccttttcattcttttttctctgatcttgtcttcacactttatttcattatgttgatcttcaatctctgatatcctttcttccacttcattgatttggctattgatagttgtgtatgtttcacgaagttctcatgctgtgtttttcagctccatcaggtcatttatgttcttctctgaactggttattctagttagcaactcatctaaccttttttgaagattcttagcttccttgcattgtgttagaacatgctcctttagctcagaggagtttgttattacccaccttctgaagcctacttccgtcaattcgtcaaactcattctctgtccagttttgttcccttgctggcgaggagttgtgatcctttggaggagaagaggcattctggtttttggaattttcagcctttttgcgcagggctttcctcatctttatggatttatctaccttttgtctttgatgttggtgacctttggatggggtttttgtgtggatatcctttttgttgatgttgatgctattcctttctgtttgttagttttccttctaacagtcaggcccctctgcttcaactctgctggagtttgctggaggtcctctccagaccttgtttgcttgggtatcaccagcagaagctgcagaacagcaaagattgcttcctgttccttcctctggaagctttgtcccagaggggcactctccagagctctcctgtgtgaggtgtctctcgacccctgctgggaggtgtctcccagtcaggaggcgcgggggttagggacccactggaggaggcagtctgtcccttagcagagctcaagcactgtgctgggaaatccgctgctctcttcagagctggcaggcagggacattgaagtctgctgaagctgtgcccgcagccaccccttcccccaggtgctctgtcccagggtgatgggagttttatctataagcccctgactggggctgctgcctttctttcagagatgccctgcccagagaggagtaatctagagaggcagtctggctttgccgagatgtggtgggctctgcccagttccaacttcctggctgtgaggggaaaactgcctactcaagcctcagtaatggtggacaccccttcccacaagaagctcgagcgtcccaggtcgacttcagactgctgtgctggcagtgagaatttcaagcaagtggatcttagcttgctgggctttgtgggggtgagatctgctgagctagatcacttggctccctggctttagccccctttccaggggagtgaatggttctctctcactggcattccagtatgatgaaaaactcctgcagctagcttggtgtcttcccaaacggccacccagttttgtgcttgaaacccagggccctggtggtgtaggcattcaagggaatctcctggtctcctggttgtgaagaccctgggaaaggggtggtatttgggcaataatgcacagttcctcgtagcacagtccctcacagcttcccttggctaggggagggagttccctgaccccttgagcttcccaggtgaggcgacgcttcaccctgcctcggctcaccctctgtgggttgcacccactgtctaaccagtcctagtgagatgagccgagtgcctcagttacaaacgcagaaatcacctgccttctgtgttggtctcactgggagctgcagattggagctgttcctatttggccatcttgccagccacccctgtatttaattataattattgatcgatagtttttaaatctgtcatcttgatatttgttatctatttgttcaattactcatccttttctgccttataatcaagtatttaaaaaacagtcctttttattttcttatatactttttaagtatgcctctgcatgctttttttaaggcattgctctgaatatatacatatatactgaatgtgtggaaaatcaccgaagaatttttttttccttttacttggtatagaatttgaggctgacaggtatttttcccctgcagcattttaaagatgatgttcaattgttttacaatgtcctttgtttctattcagaggttggctatcattcttatcattgttctggtgtatataataaatctttttcctctggcttctttaaaattttcctggctttggtttttagaagtgtattacatgtgtgattttctttgaatttacctaacctgggttttgctgagcttcttgaatctttatgttcatgttttgtaccagatttgggaaattctcagccactgtttcttcaaaggctttttttttttttttttctgcctcatcttttttctcctctccttctggaaatccaattttacgtatgttagaagacttgctattatctcatgttactaaacgtctgtttactgaaaatttttttcatttgttcagtttacatcatttctattgatccatcttgaggcatcagtacttctgcaatgttcattccactgttaagcccattcagggaatttaggttgtgtttgtttgttggtttatttttttttattttttttgtggtgggttttttttcttttcttttttattatgctttaagttctagggtacatgtgccacaacgtgcaggtttgttacatatgtatacatgtgccatgttggtgtgctgcacccgttaactcatcctttacattaggtatatcgcttaatgctctctctccaccccacaacaggccctggtgtgtgatgttccccaccctgtgtctaagtgttctcattgttcaatgcccacctgtgagtgagaacatgcggtgtttggttttctgtccttgtgatagtttgctcagaatgatggtctccagcttcatccatgtccctaaaaaggatatgaactcatccttttttatggctgcatagtattccatggtgtatatgtgcaacatttacttaatccagtctatcattgttggacgtttgggttggttccgagtctttgctattgtgaatagtgctgcaataaacatatgtgtgcatgtgtctttatagcagcatgatttataatcctttgggtatatacccagtaatgggatggctgggtcaaatggtatttctagttctagatacttgaggaattgccacactgtcttccacagtggttgaactactttacactcccaccaacactgtaaaagagttcctatttctccacatcctctccagcacctgttgtgtcctgactttttaatgattgccattctaactggtgtgagatggtatcttgttgtggttttgatttgcatttctctgatggccagtgatgatgagccttttttcatgtgtatgttggctgcataaatgtcttcttttgagaagtgtctgttcatatccttcactcattttttgatggggttgtttttttcttgtaaatttaagctctttgtaaattctggatattagccctttgtcagatgggtagattgtaaaaattttcccccattctgtaggttgcctgttcactctgatggtagtttcttttgctgtgcagaagctctttattttaattagatcccatttgtcaattttggcttttgttgccattgcttttgttttagtcatgaagtctttgcccatgcctgtggcctgaatggtatttcctagcttttcttctagggtttttatggttttaggtctaacatttaagtctttaatccatcttgaattaatttttgtataaggcgtaaggaaggaatccagtttcagctttctacatatggctagccagttttcccagcaccatttattaaatagggaatccttccgccgtttcttgtttttgtgaggtttgtcaaagatcagatggttgtagatatgtggtattatttctgagggttctgttctgttccactggtctatatctctgttttggtaccagtaccatgctgttttggttactgtatccttgcagtgtagtttgcagtcaggtagcgtgatgcctccagctttgttctttttgcttaggattgtcttggcaatgtgggctcttttttggttccatatgaactttaaagtagttttttccattctgtgaagaaagtcattgatagcttgatggggatggcattgaatctataaattaccttgggcagtatggccattttcacgatattgattcttactatctatgaacatggaatgttcttccatttgtttgtgtcctcttatttcattgagcagtggtttgtagttctccttgaagaggtccttcacatcccttgtaagttggattcctaggtattttattccctttgaagcaattatgaatgagaattcactcatgatttggctctctgtttgtctgttattggtgtataagaatgcttgtgatttttgtacattgattttgtatcctgagattttgctgaagttgcttatcagcttaaggagattttgggctgagacgatggggtttctaaatatacaatcatgtcatctgcaaacagggacaatttgacttcctcttttcctaattgaatacactttatttctttctcctgcctgattgccctgtccagaacttccaacactatgttgaataggagtggcgagagagggcatccctgtcttgtgccagttttcaaagggaatgcttccagttttgcccattcactatgatattggctgtggatttctcataaatagctctcattattttgagatacgtcccatcaatacttagttcattgagagtttttaggataaagggctgttgaattttttcgaaggccttttctgcatctattgagataatcatgtggtttttgtctttggttctgtttagatgatggattacgtttattgatttgcatacgttgaaccaggcttgcatcccagggatgaagcccacttgatcatggtggataagctttttgatgtgctgctggatttggtttgccagtattttattgaggatttttgcatcaatgttcatcaggggtattggtcaaaaattctctttttttgttgtgtctctgccaggctttggtatcaggatgatgctggccttataacgagttagggaggattccctctttttctgatgattggaatagtttcagaaggaatggtacctgctcctctttgtacctctggtagaatttggctgtgaatctgtctggtcctggactttttttggttggtaggctattaattattgcctcaatttcagagcctgttattcgtctattcagggattcagcttcttcctggtttagtcttgggagggtgtatgtgtccaggagtttatccatttcttctagattttctagtttatttgcatagaggtgtttatagtattctctgatggtagtttgtatttctgtgggatcggtggtgatatcccctttatcaatttttattgcatctatttgattcttctctcttttcttctttattagtcttggtagcagtctatcgattttgctgatcttttcaaaaaaccagctcctggattcattgatttttttgaagggtttcttttgtctctatctccttcagttctgctctgatcttagttatttcttgccttctgctagcttttgaatgtgtttgctcttgtttctccagttcttttaattgtgatgttagggtatcaattttagatctttcctgctttctcttgtgggcatttagtgctataaatttcactctacacactgctttaaatgtgtcccagagattcttgtatgttgtgtctttgttctcattggtttcaaagaacatctttatttctgccttcatttcgttatctacccagtagtcattcaggagcaggttgttcagtttccacgtagttgagcggttttgagtgagtttcttaagcctgcgttctagtttgattgcactgtggtctgagagacagtttgtaataatttctgtgtttttacatttgctgaggagtgctttactttcacctatgtggtcaattttggaataagtgtgatgtggtgctgagaagaatgtatattctgttgatttggggtggagttctgtagatgtctattaggtccgcttggtgcagagctgcgttcaattccttgatatccttgttaattttctgtctcgttgatctgtctaatgttaacagtggggtgttaaagtctcccattattaatgtgtgggagtctaagtttctctgtaggtctctaagggtttgctttatgaatctgggtgctcctgtattgggtgcatatatatttaggatagttcgctcttctcattggattgataccccatcattatataatggccttttttgtatcttttgatctttgttggtttaaagtctggttttttcagagactaggattgcaacccctgcttttttttttttttgtttgttttccatttgcttggtagatcttcctccttccctttattttgagcctatgtgtgtctctgcacatgggtatcctgaatacagcacactgatgggtcttgactctttatccaatgtgccagtctgtgtcttttaattggagcatttagcccatttacatctaaagttaatattgttatgtgtgtatttggtcctgtcattatgatgttagctggttattttgctcgttagttgatgcagtttcttcctagccttgatggtctttacattttggcatgtttttgtggtggctggtactggttgttcctttccatgtttagtgcttccttcaggagctcttttagggcaggcctggtggtgacaaaatctctcagcatttgcttgtctgtaaggtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccaacctttctctctggctgcccttaacattttttccttcatttcaactttagtaaatctgacaattatgtgtcttggagttgctcttcttgaggagtatctttgtggtatttgctgtatttcctgaatttgaatgttggcctgccttgctagcttggggaagttctcctggatcatatccagaagagtgttttctaacttggttccgttctccccgtcactttcaggtacaccaatcagacgtagatttggtcttttcacatagtcccatatttcttggaggctttgttcatttctttttacccttttttctctaaacttctcttctcacttcatttcattcatttgatcttcaatcacagataccctttcttccacttgatcaaattggctactgaaggttgtgcatgcatcgcgtagttcttgtgccatggttttcagctccatcgggtcatttaaggtctcctctacactgtttattctagttagccattcgtctaatctttttttcaaggtttttagcttctttgcgatgggttcaaacatccttctttagctcggagaagtttgttattaccgattgtctgaagccttcttctctcaactcatcaaagtcattctccatccagctttgttccattgctggggaagagctgcattcctttggagaagaggcactctgatttttagaattttcagcttttctactctggtttctccccatctttgtggtcttatctacctttggtctttgacgatggtgatgtacagatggggttttggtgtggatgtcctttctgtttgttagttttccttctaacagtcaggaccctcacctgtgggtctattggagtttgctggaggtccactccagaccctggtttgcttgggtctcaccagcagaggctgcagaacagcaaatattgcagaacagcaaatgttgctgcctgatccttcctctggaagcttcgtctcagaggggcacccggctgtatgaggtgtcagttggcccctactgggaggtgtctcccagttagcctacttgggcgtcagggacccacttgaggaggcagtctgtcctttctcagatctcaaactccgtgctgggaaaagcactactctcttcaaagctgtcagactgggacgtttaagtctgcagaagtttctgctgccttttgttcagctgtgtcttgcccccagaggtagagtctacagaggcaggcaggcctccttgagctgtggtcagctccacccagttggagcttcccagctgctttgtttacctacttaagcctcagcaatggcagacatctctcccctagccttgctgtggcattgcagtttgatctcagactgctgtgttagcagtgagtgaggctctgtgggagtgggaccctctgagccaggtgcgggatataatcttctgatgtgccgtttgctaagaccgttggaaaagtgtagtattggggtgggagtgtcccagttttccaggtaccatctgtcatagcttcccttggctaggaaagggaattccccgaccccttgtgcttcctgggtgaggcgatgccccactgtgctctgtgggctgcacccactgtctgacaagccccagtgagatgaacccggtacctcagttggaaatgcagaaatcacccgtcttctgcatcactcacgctgggagctatagactggagctgttcctatttggccatcttggatcctcctatcagtttatttttttaaatttccatttctttactgagattctctttttattcattatattcacctgttcatttcttacatattagaccttttttatattcatcttttcatttcttaaatattagacctgtttgtatctaaatgccaatatctatgtcatcttaggatcgatctgttgaaggcctctttctctggattatgggtcacattttcttgtttctttagatatccagtgattttttttaaattggttaatagactgtggatcttttcaatataaaagttgtaaggaaatatagaatacactgttttcctttaaagggtattgaatttttttcttgtaggcagttagattagtaaggaatactcttgatcctgtcagactttgttttatgctttgttaggatgggtttattttgcttttgtccttagtcctagagcatggtccttactctaggacatgacccttatttccaaagcatggcctttttagggttgtaagtggttgaccaaggtaagcaatgaagtattcccactatagttggattggaactccaatgtctccaaaactatgcaacctttattatcttcttcattaacagcagctactctctgttagaccttacagagcctcactctacacatgtgcagcccaggccttgccaagacccaagggaaacccccacacagactcttggagcatccctccacatgactgcttcatttctagtaccctgccctggaaattcagctgtctcagcagccccagactcctatctgtttcatgagcccagtgagactagtgactgcttgatgctatgactcctccttcctataccgttgtctggaaagtgtcaccaagtacagagccagggtgaatatgggggttatatcatgttttttcttactctcagttatcaagctgctgcatacattttatctagctttatagctaattagggcagaagggtaaatctgataccaattatgatatcatggatggatgcaaaagtctccaattcagtcatttatccttttttataatcagataatttaatccattactaattatgtgtataattcatattttatctttagaattttttattttcctctaattttttattttggttccctccactattgagagttatttgctatgatcttatgcagtgacatatttgcataccaatgcagtctatcattctgatgatagttctgctgtaatttaccttgttttaaaaatatattttcttgaatttttattatactaataaacctggaataatttaaaaaataatcatttaaagcatgacataaaactatccattcaatttttgagcaaattatgttggttctatcttcagtgcatatacagagtcccactaccctaatctaaaccactattttcttctgttggctgggctgttacaaaagcctaataacccagcccccttctaccttgcctctccctcattcagttttccacatagcagccagaatgatatttctaaaatggtgaataaactgtgtcacttatgctcagaaacccccaatggcttctcatctcaaaatgaaatccaaagttcctaccatggccagcaaggttatacattacctgatccctactacttccctgacttcatcttccactcttcagctactttgctacagcttcactttgacttctttgctatttattgatcatgccaaacacaatcccttcttagctcctttgctcttattgttaccactgtttttctccagatatcccataacttcctccctttctatttaaataccatcctttctcctcactgctgtgtttattaccctccttcccatattttcttttgaatcagacagatcagtcaatcaatcagtcagtcacttatttttatcctgtctgtgcagaacactgtccaatagaactttctgggatgatggaaattttctgtatttgcactgtccattagagtagctgctagccatgtgtgtctgttaagcacttgaaatgtagctagtatgactgagaaactgaagtttaaattttatttaaatagccacttatgacttgtggttactgtattgtacagtacagaatgtgtgagagagggaaccttaattttattaatgcaacccagtactttagtgcctgctatgtagtaaatactatgaatatctgttgaaagaacaaaagaatggggatacccatgtatcctgttgctccctgaatccttgaatctttaaaaatattttaactttaaaattgtatttaattgacacataatttcacatatttatggagtacagtgtgatgttttgatacatgtacacattgtgtaattagcatattacctcaaacacttgtcatttctttatgatgagaacattcaaaaatcctctcctcattattttgaaatatacggtattgttaactgtagtcactctactgtgtaatagaacaccagaacttattcctcctatctattactttgtatctggactcttttgatctataactcccgattgaacatttttatgtcatctctagcaattcccagacttccaggtgtttggcaatgattctttagatccaggggtcttctccacaaagttcagttgtgcatcaaagatcctgaataatcttctaaattagactagagcatatttggcaatgtgggttacaaacaagggaaaaaatgcaagatataggcaacagatgagggaaatgcaagatataagctcaatcacaaagcttatatttgggggaagtattaaatgaatgtatcttttccttttgcattctagccaggaatccacatgaggtgacacttttcccaagggtaaagagtaccaaatctgtcttctttctctcctttattcctccaaataagagctctttgaacttttgaaaattccctgaagatactatccatcatgaactttgagggaccacgaaataagccactcctactagctttttcttatgttaaaattatcatggctgctatctttataagaaaattcttatgactgaaaatccttatggccaccctttacaataggaactacagttttgaaaaatgggcttagccattttaagtaactgctgaaagatattcttaaaacttaagcgtgatgtatttggtttggatactaggaatgcaggtaatgaggctggcattattatgaaaaattgaagagtaggaaatatattcttgtaggatcccataagcagggcttcaaaatgtagttcttgtttatctaaactaagtaaagcttgtttttctaatcagcaggaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacagtaagttaaaggcagggcatttcccccctcctccttcctcatgttcattttaaaagttatatcatcaattaagattggaaaaaaaaaaccctcaaaatgttttctcttacagcacgtacctattcaattttaaattcatgcttttaaaaatgtataattctttaactctattatatatattatatatatggagttatatatatatatgcataccaatttttcttcaagatacttttcaatacttaaattatttcttatggcaccagtgtgatagcctttgataccttatcatttattgtttacttatttctgtgagaaatgggttgaagattggttacagcttctcctacatagccctcagaaaaactgaatttacaaataaatgcaaccaataaaagttgcatttaccagtaaaagaaaggcaggtggactaaggaggaaaatctgtatagaccaaaggagatttgggtacatattttggtaatttaaggcaaacctgatattttttagttatttgggtaagacactgcattgcctaattctgacaatacagatgtggcttcatatttttgctagcaagtgtggggagagttgggggaccaaatgtgaatattgagtccaattgtttgaagttcatttcattctttcgtctcttttgctctttccttcttttttctcttccttcctttttcttttcctgtcacccaggctggagtgcagtggcatgatctcagctcactgcaacctcaccctcccaggttcaagtgattttcccacctcagcctcccaagtagctgggaccacaggtgtgcaccaccacacctggctaatttttatattttttttgtagagatggggtctcaccatgttgctcaggctggtctcaaactccagacctcaagtgatccgcccaccttggcctcccaaagtgctgagattagaggcatgagccaccatgcccagcctcctttttgtttttctaacatacccttttattataacagaaacagtaaatgtgcattgtagaaatggagcggtttcaagttacattttcatcacccagaaattgtgactgttaacaccagtatgcatactgtctaagtatttgtctgtacatgtatttacaatttcaaaatactgagatcatactgtatttctgcaatctgcttttcattaatgatattaccgaatatccagcccatatccatttattccccaactaacccataaatgacttacagtttatttgcttaaactagtagccaattcaggaccacatatcatcagattatgatatttagtaagtttcttttttttctaatacagttatttagttgtttattctgaaaaaaaaaaaacaacaaaaccaggtgtatgtatgtgcatatacacacacacacacacacaaacataccacatacacacttacataccaggtatatatgtatatgcagttatttttgctattatttaaacaaggtttaagacttgaatttgttagaatgtggacttttcctttcctgcttttgatgttttcatgtttggcttacttttcattttaagaactattttgtggacttaaaagctctataatttacctataagaagagtaaggcagcatttctgcatgatagtattcttaacctagctaagtaatgttttagaatacagctagttacaaagagtaagttatttggaatctaccaaatagtaagaaatcctgtttctaaaaaaagaataggatctacagcacacataaaatagtgtttattattaaaaaaccaattaagttggcagtttcattgtaagacagacaatttcaaacatttgaccccaaatctaacggtcctttcttgtatgagccttgggtgtaatctttacatttttcagttaatacttaaaaatttgtgctgtgacagtatttcattgtaaagaaatgtccatttattttgtctataatagtaactttatagcatgaagagtgtattcaggttgatactcaccaaatctgatcatgcctgtttctacagatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtg

SEQ ID NO: 3 - DNA, 48525 bp, Homo sapiens
  misc_feature (1)..(48525): DNA nucleotide sequence of the entire GAS6 genomic locus including 5000-bp upstream sequence.
aagaaaacagaataaccaaacaactgcacactttgagaaagaagaacgtttgagtatttacactacctgagtatttacattacctgacttcaattcttgttatgaatctactatagtcaagacagtgtggtattaactttaaaaagagacaaacaaataaatgggacagaacagagtctacaaatagatttgcacatatattatcaattggttattgacaaaggtgcaaaggcaagtcagtggagaaagaatagtctttttaacagtgctgggatgattgcatttccctaggcacatacgtacagatacacactttgtttcatacttcagcatttataaaaactcattcaaaatggatcaccatcttaaatgtaaaactgaaatctacagaacttctgtaataaaatctttgtgaccttgagttaggcaaatgtgacaccaaaagcagaatccattaaagaaaataagctgcacttcaaaattaagaattctgatctttgaaagacactttaatttctttttatcttggagacagagtcttgctctattgtgcagaccaggcttaaactcctgggctcaagaaatcctcctgcctcagcctctcaagtagctgaagctacaggcacccactaccatgcctggctaaagacacatttaatagaatgaaaagacaagccgcagactggaaataaatatttgcaaaccacacatctgataatggacttgcttctagaatagttatagaactcttaaaactcaacaaacagctcaacaattggaaaaccaaacatcccaagtgtattagtcaattttcacgctgccgataaagacatacctgagactgggcagtttacaaaggaaagaggtttaactggactcacagttccacgtggctggggaagcctcacaatcatggcagaaggtaaggaggagcaagtcacgtcttacacagatggcagaaagcaaagacagagagcttgtgcaggggaattcctctttttaaaaccatcagatcttgtaagacttattcactatcatgacaacagcatgggaaagacttgcccccatgattcaattacctctcaccaggtccttcccataacatgtgggaagtcaagatgagatttcggtggggacacagccaaaccatatcaccaagtaaaggaaaagaaagaaagtaaaactgaaacagacatttcaccaaagaagatatctggatggcaataagtacaataaaatttgttcaacatcactagttatttgaaaaatgcaaatttaaactacaatgaaataccattatatacatattagagtgagtaaaattttttttttcagtggagtgtagggtttctttttttatttttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctggatacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccccaaaaccgccattgtcatcatggcccgttctcaatgagctgttgggtacacctcccagacggggtggtggtcgggcagagggcctcctcacttcccagtaggggcggccgggcagaggtgcccctcacctcccggacggggcggctggccgggcggggggctgacccccccacctccctcccggacggggcggctaaaaatttttaaagtgaccacagaaagtatgggtggggatgtggagcaactgggaccctcatgcattgatggtgaaaatgaaaaacagtataaccactttgaaaaacagtttaaaaagttaaacaaatacctactatgggatccagacactctgctcctagatatttccccaagagaaatggaagcacgtgtgcacacaatgtccacacgatggacacacacatgaatgcctacagcagctttatttgtgatagtaaaaatttagaagcaagtataatgtccctcaacaggtgaatgataaacaaattgtgttatatccatacagtggaatactactgagcaataaaaaggaatacacctgcaacaagatagatgattctgaaaataaatatgttaagtgaaaaaaacagacaaaaaagtgtacatacagtataattctttttatataaaagtctagaaaatacaaacaaatctatagtgatagaaagttggtcagcggtttttgcatagaaactgggatgtggggtagggtggggacatttaggagggaggaattaccaaagggcatgagaacacttttttgggtgatggatatgttccctaacttgattgtgatgatggcttcacaggtgtacacagctttccacctcatggccacagaccggttaaccatccatataaaacatccattgccctgggtccaacctcctgccccctgtggaggtgaactgtctacttcaccattgatatttcaggttgtatgatatagtgcctgacaactctccatttttggaacacatccaaattgtttcttattcattttccatttctgccttcgaacgaatttcctgcactggtaactaggtgaagaattttggagttatctggggtaatggagacatcctccattgcaccgcatatttgctttctgtattccccagttatagaaatcaaaacgagcagttgtatgtgaatgcattgtatcaaaccaagtctctagatgataggaggcattgtcattactaggatagtaactcagtagaaagagtgaattgagaatatgaggaatgagagtggggtccagactaaaaggaggccaggggtcctgaactgccccatccaactgagttcattctgatacctactgatctgaagcagcaggtccacgcccaggtgcagattgtcccagatgaacaggcagaggctagagatgctcattcctaaagggatcaaataattctgagaatggcaagaactccattaactctcttctccaaaactacaaaaatgtgcagaaaatacgaacaatttttaggagcttacactctttgaagtttatccatgggctgctggaacccttaggaaataatagctagaagtgcctcagacactgcctggcacacagcaggtgctcaatgaattacactgcctggcacatagtaggtgctcaatgaattgtctgatgaagtgattaaggagccttgtaaatactgattaaaacatgtatcaccccatccaatttttcaaaccagtgcttctcaagaacaagcaggaaaattaatgtaatattgttttgaagtagccgtggtggtttcggggcagaagcccaggggtactccttactccgcctgctccagtaactagctgacatggaagtgcctcgtcattctggttcagacacaggtgcagatagatgacttctctatcccactttaattctccttgaagatcattcccagggacattcatttgcttaaattaacatgctcggccaggcgcggtggctcacacctgtaatcccagcactttgggaggcccaggcgggcggatcacgaggtcaggagattgagatcatcctggctaacacggtgaaaccccgtctctactaaaaataaaaaaaatcagccgggcgtggtggcgggcgcctgtggtcccagctactcgggaggctgaggcaggagaatggcgtgaacccgggaggcggagcttgcagtgagcagagatcacgccactgcaccccagcctgggcaacatagcgagactccgtctgaaaacaaacaaacaacaacaacaaaaattcatgctcataatcccactttcaaaccagtgacctcaaagatttctagcagcaatcctattccattcttccaattacagaaagcaaagagaaactggatctggggatctaagcgttgagcctgctgagcagaacggccattcatttggggtgaggtgctgactcactgcccctctacattgcattttggggtgtggggatttccagagcaggattctccagagaggagtatccaagctccctcctcccgcagcagggggatgctgggctaactgcctggttcggtcccccgtgagtggtctgctgtgttttggttctgtttgtttgtgtgtgttttgcctatgactttgcgaaatattccaagacaagagccagaaagtcttggtctctgaagacaagcacaatgttgctttcagcttaaatatctactgggaaacctcaagatttttaatgtcatcattatgaaaaacagagattataaaaggaaaccgtcgcatttcactcgctggcccccagtgggattggatctgacctcagtgtatcttttctttggtaggttttaagtcttgacaaaatgtgcctaagaatgaagactccaaaaaggatgcagtagattcggggggagtgggggttggaaagaggcttaaatcttcacatgacacctggaatatggtcaaaatgtacctgctcaagttgaaccaggtattgcgtcctccttttaccccatcgctagtgaagacaaccaccgcctggggagacgctccttttccgaaacactcgagtcccgccgcgtcccggacgctccgctttccccgcgcccggatcctcccgggaacccgcgccccgcccgcgcgctggtcccgcccccgccgcctccccgcgcgcagccgcccgaacacgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 4 - DNA, 23252 bp, Homo sapiens
  misc_feature (1)..(23252): DNA nucleotide sequence of the entire HAPLN3 genomic locus including 5000-bp upstream sequence.
actgcggagctgggttccctgaggagctgcctgcctgtggacaccctcaggaccagtgtcagactgtgggcggcgccgcagggagcctctagagcagttcatgcccctccaggctgtggcctctcctgtccttcttcccatcacagtgcagtgcaggtctcaggcaggggtggttggcgtggagttggccagggcccagaccctatgagctttatagcagtgaggtaccgaacaccatgtgtggcaaagtaggtggtattatttatgccccctcaccgctttttttttttttttttctgagacagagccttgctctgtcacccaggctggagtgcagtggcgccatctcggctcaccgcaacctccgcctcccaggttcaagcggttcttctgactcagcctccctagtagctgggattacaggcagccaccatcatgcccagctaattttttgtatttttagtagagacggggtttcaccatgttggtcaggctggtctcgaactcctgacctcaggtgatccacctgcctcaagtctctcccaaagtgttgggattataggcatgagacaccatgtccggccttatgcccattttatagccaaagaaactgaggctcacccaagtagtttttttcaaaactagaattcatgcctcagtgtgtctgcctcttttcaccttactggagatggtccaagcagagaaaatgtggttggtttcttctgtaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaaggtgggtgtctgtccagctgcccaccctttgccattccttcattacttccctgggagtctggcctggggctctgaggggaggggggctggctcggggtcctcctgacacccgctctgcctctagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaactcttggtgtggttcgttattgtttcatgggaatgggatttaaattgcgctggtttccccatcccccacctgtggtcctccctgagccccagcttgcttgcttgcttttttttttttttttttgagatggagtcttgctctgtcgccaggctggagtgcagtggtgtgatctcggctcattgcaatctctgcctcctgggttcaagcatttctcctacctcagcctcccaagtagctgggactataggtgcacaccaccatgcccagctaagttttatatttttagtagagacagggtttcaccgtgttggccaggattgtctcaatctcttgaccttgtgatccacctgcctcggcctcccaaagtgctgggattacaggcgtgagccaccgtgcccagccccatctttctttatgtcacctgcctgactacacatagcttcatagcaggaggctggagactttggtccagggcggcctgaaggaagtcaggacttccaggtcctcaaaacctgacttcccctcttccctctgctttctacctccatgccgtctggccctgagccctacaactgctgcctggtcaggggcccagcgagtgctggcagacactgtctcctgaatgcttttgctcccttcctgccaggaagactggctggggcagctggttttccccttcagcagtttccattctctctgcaactggagtggtgggctggagaaactataagaaactcagtgaacctggatgccttccgaactgcgggagttcctggggtgggtgcagcgtgggactggaggagggggccggggctctgccaagtgggcatgaggcctcctgcctgaacacactggttcctggtaggccactggcgtgtgtgctccagggataccctctctgccctcccctgtgtgggggtcatcaagaagtgggggtgggccttgcgggccagtgtcttggtgatctggaagggtgacttgcaggcagaggcttggctagcttgggaaggggtgtaggaaaaaccaccctctttgtcaaggtgaatttttccaaactttgggagccggctgtgttctgcaggcagggggtgcatctgagcagcaggaggtggggccgcctctgagcagcaggaggtggggccgcctctgagcagcaggaggtggggccacagggctgccaaagggagggcgtggctttgctggaaccacatcagggaaatgtgtctggaagtggttcctttctgagacctgcggttgctgggctcctgggcctagcagggtctgaataaaaggcccaggccgtggtcttcgtaggaactgaggatgggggactcccttcccctgggtgtcccttggcctactgcctcccgtttcagagctctcttctgcggagcggtgtggattgggtttagagccaagcctttctgcgtgcttccaagcctcaggtctccctcccgggggagtttcctgccctgaacccctgttccagcataccctggggataagcagacagtgggagaagcatctctgctctgggatgggttggccacagccttctaaaagtccccctcctgggaccctggagtggagtcccctcactcctgaccccctccttccttccttggcttctctccctcagcagtgtcttccatttgcccagcttttaccatcacccctacacattgacttttttctgccccactgcaaggcagagggtgagcgttcagattccacctgctggctacccctacccctggctggcatgttcaactcgacttaactgtagcaaaatgtgctctccctactgtccatcctctcccctgtcgggaacctgcagagggacctaccttggctcccctttgcccatcaagcctggcgttccttttaggtgtagtttacctgttgatcacagttctttgtgctccaatgtgcccctggctgtgtgtaacacacacacatgcacacacacacacacactcatgggccaacttgagctgtgtttaggaagaggctctgagctctgtgaccctgtgacccttcgacccttcccccagccaaagctgaaggacctccttagtcttttctgctgaggaaacatcgggctgtccaggccagggcccccattggtctggacaggaaagaaaacaccctgtccaaacagaggcatcctgagcggctgcctggatggctgtgctgattagcaggattccgaagggaggcccacccctgttggaggaccactcagaagcctgattgcccctgcaggctgcagaggtatcccaccctgtgtctcccctcccagccagggccactcattcaagccccatgtgctggggatagcacctgctatgtgcctgacagtgagttgggaatctggccagtgtttcatgatggccaaactcaggggcatgaggacatcagcaaccccttgctttttttttttttttttttttgagacggagttttgctcttgttgcccaggctggagcacaatggcatgatctcagctcactgcaacctccgcctcctgggttcaagcaattctcctgcctcagcctcccaagtagctgggattacaggcatgctccaccacgcccagctaattttgtatttttagtagggacagggtttcaccatgttgcccaggctggtcttgaactcctgacctcaggtgatccaccggcctccacctcccaaagtgctggggttacaagcatgagccactcactgcacctggcctcacccccttgctttctatttggaaaagaaagtaatacagaagtctcaccccttccacaatcaaaggtggggagcagccttagcccctagcagaatgctggacaggggcttcccctgcttactcccactgtttttggtataccaggctttctaaggggatcccccctccccaaactctcctattccacccctactctcctttcccaagacgtgagggcctcaactcttgcacaccctctttgcggtggttcccagcgagtctggagaccgctcaagcctgcagcagctcctcccttcgagcccagcccttgggagggaaaggtgcgcgtgttcctttaaggggctggtctggcgggagcgcgggggtttttctgctgccgcttcctttctgcccttttaatttccccgaaatcagactgctgccttggaccgggacagctcgcggcccccgagagctctagccgtcgaggagctgcctggggacggtacgtggcttaggggtcgctgggcttctggggctgtgtgcgggccgggttcctcccttaccgctttgggtgccctgcgggtccccacacctcccgggcagggtccggggaaggggcaggaggcgtgggccgggcactgcggaggcccgggctgagatgggctgtgatcgcgggcgaggggcgcccggggcacaagtggggagggagcggcgcggggatgcgggcgccggaccctcgtgcccaccgtgagggagcagagcccgagcggaccccgtggcctccgagaccaccgtccgcctccagcccccttcctgccagggtccgcttggctctctcccctgtcgtctgtccagggtcggctgcctccagtgccgtccgcggcgccccaggccctgcccctgggtatctgttggatgctccgggggccccgggagtcctgggaggggctgagggcaacctgcgaggcggctggcggacctgcgcctctggaccgcagctggccggctctgggcgcctggggcaaaggcaactgatgcctatgggttccagacctcgctcaccggggttcttgccccagggacagcgaggccagaagggtagggagggtggagggcagagccctgggtgggagatggcgaccctcagggagaaacgtaggcttgtgcgcagccagtatggaaacagcacggcacttggacccagtcctgccaccagctcgttggcagccacaggccacaggcagcctgtaaacctgttgggaccttggtgtccagcgctgacccgcgggagtgcctgtgctccctggagtagggggcagcgattgagaggggccctggcttctctccctcgacgccgcccgggccagcggattgggaaacacctccggttttcattctcctgggggctgcaggtttcaaaggcggagatcaagccttgtgcaaacagggacagggatgtcaaatttctcgctgggagcagcgctcgtgcagacctcgcgggcgatgctgcctcctgctggtacctgggggacttgtactcacggaaggcccagtgcggacatgcacctggcagggaggtggcacctaccctccctccaagcccaggcttattgttcttgggtggaggggtccctaggctggggcgcctgggaaaagcaaagggctggtcatcaggaaacctgaactttctctaagttcgagatatttgacaaagataacgccttgggtagttcactgacctccactctcttggcctcagtttcctcaactgtgaagaggaggcagtggtgaccactttgtctcgtaggcagtgagagaggagaaagagccactgagatggtgtaagacttcactgtgtgaactgctcaccagagtagtaacaggtcatattttcccagtgcttgctccttatcaagcatcaagcagtattttcagtgctctgcagctattctctcccttaatcttcacgagagtgttttctgtttggtattgtcgtgaccgccccccccaccccaactttttttttttttttgagatggagtctcactcttcttgcccagactggagtgcaatggctcaatctcggctcactgcaacctccgcctcctgggttcaagcgattcttctgcttcagcctcccgagtagctgggactacaagcgctcatcaccacactcggctaatttttgtatttttagtagagatggggtttcaccgtgttggccaggctagtcttgaactcttgacctcaggtgatctgcccacctcagcctcccaaagtgcagggataacaggcatgaggcactgtgcctggcttgtgacccccattttaaagatgaagaaactgaggctcagagaggtgcagcgacttgtccaatgacagagggttagtaagtgggtggagccagaactgaatgcaggcagccaatctgcttctagagcctgaaatctttgccatgttcatttgttgagcacctgctgcatgccagggaccagacatcatacatcttctataattgtcaccacagcccattttttttttttgagctggagtcttgctctgtcggccagtctggagtgcagtggtgtggtcttggctcactgcaacttccgcctcctgggttcaaacaattctcctgccttagccaccccagtagctgggattacaggcatctgccaccacacccagctaaattttgtattttcattagagatgggggtttcactgtgttggccaggccagtctcgaactcctgacctcaggtgatccaccccctcagcttccccaaatgctgtaggattacaggtgtgagccactgcacccggccttaagttccttttttttacagatgaggaaatggaggcacagagaggtgaacttgcccgaagtcactcagcaggatgcagtgtgtccagctccaataccgagcccaggtctgagtgcccagacaggactccagaagatttggggaactatccactgccaaggtgactgggctggacttggtcttgggccttccagctggtggcacctctgtggtggtcctgaggagttggtggctggatagccatggtaggggagcagaggctacccatccctcccctcagtggtagtggtcagggatggtcagagatggacctgaggcaaggcagcaaccaagtggcaattgccactcctgactcccacacaggactctgtcctgtgcactgaccttagcattcaaggctgtgcttgtcctcagcccccgagttcccctttagtcttctctggagagaggaaattttctgttcagagaggtcaaatgactttcccagggtcacccagctagcaggtggcagagccaagacccaacctcaatgagtttaacttgaaaccttgggcctgtgtgctgctcctctctcagagaggcctggaaaatggccagcttcctcctggccttttgttcttgggcacagggctgatcttttcttataattccttttgtttttcttttcttttttttttgagatgcagtttcactctgtcgcccaggctggagtgcaaaggtgtgatctcggctcactgcaacctctgcctcccaggttcaagcaattctcctgcctcagcctctggagtagctgggattacaggcacccaccaccacacccatctattttttatatttttagtagagacggggttttaccatgttggccaagctggtctcaaactcctgacctcaggtgatctaccctccttggcctccaaagtgctgggataacaggtgtaagccactgtgcccagctaattccttttgattttcttggcatccccctcaatgtgaggttacattactgctgagttagcatccaacaaagaggtgttactgatgtcacttagtggcagaaacgcctgcatttgtttacccttaggaagccctttctcactagggagcatttgtgctagatgagccgctgtaagaggctggaaacattataagcagcagctgggagcccctctgctcaaggagactctaggtgcccagggacagcggggagcccaggacatcaagctcaacatcaaatcttggccccacttccctcctggttccaggtgtggagcctgaaggaaggcagaggaaacgaactcttacaagggtttgctctgggccactgggctgtgtgtgccacacaatcacctccctgaatttggcatggttccaggctttggggctggagtgggttcgaatcctagctctgccacttcctagctggatgaccttgggcatatgacttagtctctctgtgccttggtttttccatctgcaaaatgggaacactactaggctcacatgtcagggtagtggtaaggattacatgagagataccaggtgtggtggctcatgcctgtaataccagcactttgggaggcggaggcgggcagaacaattaagcccaggagtttgagaccagcctgggcaacatggtgaaaccccatctctactagaaatacaaagaattagctgggtgtggtggcacacacctgtaatcccagctacttgggaggctgaggcaggagattcatttgaacccaggaggcagaggttgctatgagccgagatcttaccactgcactccagcctgggcgacagagtgagacttggcctcaaaacaaaaacaaaaataaaataaatgagagagtaagtgctcagctgttaatacttttatactgatcatagtaatgctgtggtgtgtgtatttgttaggacaagtgaggctaagctgtgttgacaaagagatgcaggccgggtgcagtggctcacgcctgtaatcccagcactttgggaggccgaggtgggcagatcacctgaggtcaggagttcaagactagcttggccaacatggcgaaaccccgtctctactaaaaaattacaaaaattagcctggtgtggtggcaggtgcctgtaatctcagctactcaggaggctgaggcaggaagaattgcttgaatctgggagcagaagttgcagtgagccgagattgcaccattgcactccagcctgggcgacagagtgagacttagtctcaaaaaaaaaaagatgcaaaaaagtggtggcttaaatatgataggactctgtttctctctcataggacagtgcaagtggaggaggtccagggctgatgggcagctctgccattcaatctgtggtttccatctctgactctaagctggatactgtggtttccagaaggttgggggaaggaataccagggaaaggcatctgtaattgttttaactgccagacctggatgtggcatgttatttctgcttgctgccattgatgagaactgagtcacatagctctcctagctgcgagggaggctggaaatgcagtcttcagctgaacggtcgtgcacccatctagacctctgttactttaggagaaaactagaatgcattggcgagaaatataccagggtgagttttatgatctccatttcgcaaccgaggaaacttgcccagaatctcgcagtgaataaatagtagaggtgggatttgaactctgatcttccagttcccaaactctgtaccaggttgccccattgtgcttaggcctcccagttctccatcaccaagggggcttacaggaatcaacaggggaatgaattcctcttggacaagaagtggggtttcagagttggtagtgtcctggctgcagtgcacagcacagatggcaggtctgggccttgggatttctgtggtgtctaagggaatggtggatttggcctctcaactttctttacatccattctctccagcaagagctcctaactgttctggaaacaagaatgtttcctccacaatcccatcactctaacaagccaatgctgtgtgtgtctgcctgcctcctttcctccctccttccctttccttccttccttcctttccttccttcctccccttcctccctccctccctccctccctcccttccttctttccttccttcctttctcccttctgtcctccctcccttcctctttaagtgtttcctcatcttctgggtcctgtacacaggcattcacaagaccacatggttgcaatcatagcagaggcaattgtatgttctgctttgtctattttaacttacaccctaagcattcttccacgttgctacatgataatcatagttatgtttgcagctgcctgctgtcattctggtcttgctgcccccaggtctaccttccactcagcccctgcagggaagtgtcttaagatgtgagtctgatcctgtgacttctctgcttaaagccatcactggcctccaggacaaaggatagacttctggccaggtgtggtggctcatgcctgtaatcccagcactttgggaggccgaggtgggcggatcactcgaggcgaggagttcgagaccagcctggctaacatggtgaaaccccgtctctacaaaaaatacaaaaattaatggggcatgttggcgcatgcctgtaatcccagctactcgggaggctgaggcatgagaatcacttgaacccaggagacggaggttgcagtgagctcagatcttgccacggcactccagcttggacaacagagtgagattctatctttaaaaaaaaacaaaacaggatatgcttctgggcctgacacccaaggcatccagacgctggccctggtgacccccttacctcctctcccccatgcagccagggtcttggcaggaagcagaattcagcccagatgattccaataaagagactttaatggaggaatgacttctagagagtagggtgaggggacccaacaaggaagtgggggacgcagaggccagcagcagcagcagacactctatggcagaggcactggggtggcaagggagctgggaagcaatgccccgtcttcctcctcttccctctctgccatcttctctgagtgcctcccattggctcaatcccactggaagccagaaggcctggggaactgggacaacagggaccaatacgtgtcagagaaggacagacgatggacctggtgggtgtgtggggcaaatggaggacctcctgtatacccccagcacccccaggcttgggactcttgctggcatctgcacctttgtagtggcagtgccctactggataaacctgtcagtccttctccacctggcaaactcctgcatcttcagtctcatttggacattcccgtttctgtacctccatcgtggtactcaacacacagcaatcaagactgcctgcccacgactctgccccctccctggaccaagctccttcaaggagtgaccccatcttttaattgttgagagcacgcagtaaatggcaggtgagcagggctagggtgacatgagtgaggcagtagcccttggtgtgagatttaagcgggggaggaagggagtttgctagaaatcttagtaatcaagacaaaatatttgaatacaatatttaaaaaaaaatcaaatcatcaaactacagcccatgggttggctacctcttttgagcgcccacccaaactggaatagctcccaagacctctagcatggtgttcaaaaattatttttgagttgggcgcagtggcttatgcctgtaatctcagcactttgggaggccgaggcgggctgatcactaggtcaggagattgagatcatcctggctaacgcggtgaaaccccgtctgtactaaaattacaaaaaattagctgagcttggtggcacgcacctgtagtcccagctactcgggaggctgaggcaggagaatttcttgaacccaggaggcggaggttgcagtgagcaacctccactccagcctgggcgacagagcgagactctgtctcaaaaaaaaaaaaaaagggttcacaatgcaggactcatctttacttaacataccctctattcaccctgatattttctattctagtctagtttatttggcgtcattaaaaagtgctgctcatacctttcttttcttttctttcttttttcttttttttgagatagagtttcactcttgttgcccaggctggagtgcaatggcatgatcttggctcaccacaacctctgcctcctgggttcaagcgattctcctgcctcagcctcccgagtagctgggattacagacatgtgacaccatgcctggctaattttgtatttttagtagagacggggtttctccatgttggccaggctggcctcaaactcccaacctcaggtgatccgcccgcctcagcctcccaaagtcctgggattataagcgtgagccaccatgcccagcctgcccataacctttcaaattctggcttgaaaaacattgagcctgtcatatcatcctgcttaattttctctgcttttagctgcctgatacttccttcttatgatttgtctctttgctgatctcccgtcttgccttcggggtacagctccctgaaagcaggaaccccatctagcttgtcactgctgtcttctcagctccgggaacagcgtctggcacgtaggcggcaggtgtcccgcagtgagctgttgagcaagcgagtgagtggtgttggagcagaggggatgtgggccctggaagccaggcttttctaattgccttgttttcctccccttcccagtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaaggtaggcgacctcctgcacccggctctttgctcccctgggtgacctagacctccttggctcttgctgtgatctgagggttccaggctgggacagggacagcagccctgttccagcagggcccttgtagtgggccagcttgcttctcagacaggggaaggggtgagttcattttcctgtgttcgccagccccttcgtcatggggcccaattcacttaggctttttactttccctaaaagtcttgccagttgttcaaggtccagcttgaatgtgtcctcccctggtccccccagtggaaaggggacctggggtcgaatagatgtgagtttgaatgttttttttgtttgtttttgagataaagtctcactctgttgccgaggctggagtgcaatggcacgatctcggctcactgcaacctctgcctcccgggttcaagcgattctcctgcctcggcctcccgagtagctgggattacaagcatgtgccaccatgcctggctactttttgtatttttagtagagaaggggtttcaccatgttggccaggctggtcttgaactcctgacctcaggtgatccacctgcctcgacctcccaaattgctgggattacaggcataagccaccatgcctggcccgagtttgaatcttataattctacctcttactagctgtgtggccttgggcagggaacgttttaaagtagcagttattgtgcacccaacatgggttgggcgcgcttctagatattttgcatatgtcgtctcctgtaatcacaaaagccctgatgtaggcaagggtgaaaatatacctttttttttttttttttaagatggagtctcactttgttgtccaggctggagtgcagtggcgcgatcttggctcactgcagcctctgcctcccaggttcaagcgattctcctgcctcagcctcccaagcagctgggattacaggcatctgccaccacacctggctaatttttgtacttttagtagaaatgggggtttctccatgttggccaggctggtcctgaactcttgacctcaggtgatccacccgcctcagcctcccaaaatgctgggattacaggcgtgagccaacgagccttgccgaaaatacacatttttaaccattagtgcagcacgggtgctgaccaggctgaattgatgctgtctgccctcacagcctgaaagtagattctattatcatcccttctcatagatgagcaaactaggctcagagagttgatccagttgtccaggtcaaacagctattaaaaagacaaagctgagggctgggtgcagtggctcatgcctataatcccagcactttgggagactgaggtgagtggatcacttgaggtcaggagttcaaggccagcctggccaacataccgaaaccctctactaaagatacaaaaaattggccaggcgcggtgactcacacctgtaatcccagcacttaaggaggccgaggtggatggatcacgaggtcaagagatcaagaccattctgaccaacctggtgaaatcctgtctctactaaaaatacaaaagtagccgggcgtggtggcaggtgcctttaatcccagcttctcaggaggctgaggcaggagaattgcttgaacctgggaggcagaggttgcagtgagctgagatcataccactgcactccagcctgaacgacaaagtgagactccgtctcaaaaaaaaaaaaaaaaacacaaaaaacaaaaaattagccgggtgtggtggcgtgcacctgtaatcccagctactcaggaggctgaggcatgagaattgcttgaacctgggaggaggaggttgcagtaagctgagatcacaccactgcactccagcctgggtgacagagtgagactctgcctcaaaaacaacaacaacaaacttgttccacttgtttgtggaaggaacgaaccagatggctggtctcagtaatagccagcacctgccatgaagagcgcacagcctggttcagagacgacacatgagcctgcaagtgcagtgctgggtgtttctcacctttccctctgcctttgagtagatgattgtgcctgcagaggcattttccctcttttgattagtctcctaggtcagctgtaacaaattaacacaaacttggtggcttgaaacaacagaaatgtattctctcactgctttaggcaccagaaatccaaaattagtttcactgtgcagaaatcgaggtgcggataggactgtacctcctgtggctcttggggagaatctgttcttgccttgcctcttccggttctggtggctgctggcattccttggctgtagctgcctcactgcaggctctgcctccttggtcacgtggtcttctcctcttttatatgcaaatctccctctgcctccctctaaacaggtacttgcgcatttgcatttagggcccacctgggaaattcaggataccctccccatctcgacatccttagtttaacctcatctgcaaagtccattttgctacataattaggatttagggtattttgggaggccattatttagcccaccacacccttttccttcagaatttattttgttatacaagccctactttatttatttatttatttattgagacagagtctcgctctgtcacctgggctggagtgcagtggcgcgatctcggctcactgcaagctctgcctcctgggttcacgccattctcctgcctcagcctcccgagtagctgggactacaggcatccgacaccatgcctggctaattttttgtatttttagtggagatggggtttcaccgtgttagccaggatggtctcgatctcctgaccgcctgatccgcccgccttggcctcccaaagtgctgggattacaggcgtgagccaccgtgcccggcctacaagcactactttaatgagatttgcggaatttaaaaaacttaaacttcctactcatagtttcactacactaccaggccaacatttcatttttgtctttcccttttgtccctgaatatgtaagcaaagtcatatataatccccccacccaggggaaccactgttaactttttaggtatctctttctagccttttcttttttttttttttgagacagggtctcactctgtcacaccagtgcagtggtgtgatctcggctcactgcaacttctgcctcctgggctcaagagatccttccactttagcctcctgagttagctgagactacaggcgtgcaccactgtgcccagctaatttttgtatttttagtagagatggggcttcaccgtgttggccacgctagtctcgaactcgtggcctcaagtgatctgcccgccttggcctcccaaagtgctaggattacaggcgtgagccactgcacctagctgagccattcttttatgatttagaaaactttctccaacaaaaaccagctcatgtcatacatgtgatttttgtattctcccttatcacctcatagaatagaactcgttttctaagtcaatgattgaatgtacatctaccagattattttacatggctgtatagtattttatcatatggatgtacattttcattttattcaggttaaagcttcaaaggtagtttacttaagagagttgggaagaaccaaggaagtggcccctaaatgatagccctgcttcatatttattggacactttctgtgtgccaggcatcctgccttacctgatttgaaccttaccacagccctctgtagggactgtaattaacccattctacaaatggggaagctgagtcttgacttccctggattacacagctgggaaaaggtggaaccaagggcaagcccgaattgcctgactccaaacctctgtacctactgcctctgcagagcaggacagctctaatctgaatgagcctgaaagtcccctggaggctggaccccattcccagagtctctgaggcactgggaccccacaatgtgcatttctgacaaattcctggtgatgctaatgctgctggcccgagggccacacttggagacttctgcatatggcaatctgctacattaggtatagctcttttttagcacgattcctctacagggaacctccctgtctgtctcctgcttacccatgaggctgtccccttgcctccacctttttaattaattaatttgtttttattttgtttttggcaacagagtcttgctctctcacccagtttggaatgcagtggtgcgatcatgactcactgcagccttgacttctgggctgaaacaatactcccacctcagcctcccgagtagctgggaccacaagcatctaccaccatactcagctagttttaaaaatttttttgtagagacagggtctcactttattgcccaggctggtctcaaactcctgggctgaagcgatcctcctgtcctggcctctcaaagtgttgggattataagcgtgaaccaccgtgcctggcccctgtccccaccttgagtaaatcaagcatgtcttgaagtctagacccaagagaatgaatcagtgaggtcccaacaggggctcccaagttaaagatgaggcagccttagcctatgaacttgattcttttgttgcatgttgagttctgtgtgtatttgtaactctgagccgtgagcgtagtctcctttagaagttctgcccttagctcagtaggctgctccgtatttgggaagagttatggtggacagctggaccagagagtaaagccagggctgtgctgtcctctggccagtgtggtggggaaggaaactccgacggatccctatcagggccacttgtcctggccatgtacctcatgtggggtggctcttgttgcctgctccattggttagattttatgcatagcaaaccacccaaaacttagtgacttctttaggatgacagccatttgtttagctcatgattctgtgggtcagcattttggagtgggctccatttcttcaggtcttgcggttgggtcttgcagatgtgcctgcccatggtgggcaggtcagctgggggctggttgctgtaggatggcctcagctggggcgccctgtctctgttctgtgtattctctcatcctctagcaggcaagcctggccatgtgctcatggtggctggcaaagtcctaaaaaaagagtggaagcagcaaggccccctgggacctatgctcagagcaggcatgatggataacagtcacttccaaggcattcagttggtcaagcaagtggcaaggccagcacagattcaagggggtgggggaataactgtcatctcttgatggaaggagatgcaaagtcacattgcagagcatgtggatacagggaggggtggagcatggtggccatttttgcaatctgagcctgtaggagccgtggatgagggtgtgcggtggcccttgcaggggtacagatgtgcttcagcaggtctcatctgcaccctgtctctcccccaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgagatgctaacggggactgggtgacactgggacctgagagcagaggggagaggaccagagaaaacatccagacctctgtgctttagacatttaaaagtacttaattctcaaaacaacccacatggaagctactgttgtgacccccattttacaggtgagaaaactgaggcacagagaggtcaagtaacttacctaaggtcacacagcttgtaaacgacagagctggggtctgaacccaagcacccagcctctagaatctgttcccctctacccgctgtaattcacatctcattcagagagaggaaaaccagagctggtcccacagcttattagagacagagctgagatttaagcaaggttagcgggtaacacaagcgaatgaggcagcccactgtgagacgatgggagtggtggggactgggcacactcctgagcccttgtcctgtgcccagggagctcccacactactcaggcccagctgatgatgccacgccagaatgcagaccccactgccaaattttctggcttgacaagataagcttatatttttatgtgagatctcctgatttttatgtaaaaacctcctttttaaaaacaaaacaaaacaaaaaacaaacaaaaagcccccccaaaaccaaaaacaaaaacccagtgctgtccaaaccagccacaccctgcaagccggatcttgtatgtggggtccctgtttgatctttaatttgtatttaccttctctgtctctaggatggggctgtgtgtcctcacatctctcccacatgttagggaggcagttcggggatagaggaaggtgacctgactttagccccagcccgtcccagctatgacatgtgggtaaatgcctcatcccccttagagccctgggcctctcaggtgtaaaatggggtatcacaatctttcctcctttacctccctcagaggcaatgaggataagatgtatgtccttaaaatgcgttctctgtctttgccaccagtgtccacatggcttacatggtggctcagaggggccgcattcctcattcttgaagttggggtggcagtggagttggggagaacctgcaagagtcattggtctggggtctgcaggggcagcctagagaaacagggagccctcaccccattcccggggcttcaagggctaggaatttggggtggaaccaggcatgaaatagtccccctgcaaacacacgtagaggctgcaagctgactgtcagggcccatgggcttctctgccgcccaacctggctttgcccaggtgcctggcttccggccctggtgagatcggaggtttggggctcaggctgttcctgggtccttggccacacggaggagattccaaagtgtccttcccagacccctagggtcacctccactccctaaggtttcattgacttggtagagactacatctcagaagtttaaaaactttttattagagtaaaatttcaaacacgaacatatcttttcagggcctgtggcctctatcagaccctgaccacaaggagagaaaccgcctgccccagacctccctgcccttgagcctcctttatggaaggcccttccccaaccctctccccacggcctctagggcctctccttctcctgaaaatcatctgccacacgtggaaagttccttgcattttcctaggaaatttccacattcataataacgtagacgatcgggtcccagctaacgagtggggagctgggagtcaaacctggcccctagagcccaaagcccgggcctgtctggagaagatggcacagcctcactgggggtctggcgacagccttgcggattaggttggggacattgttggggacattaatggactaattaattaccttaactcatggatgttttctgagtactgctgtgaaccagctgagtcccaggagagaggcggcaacggacaggaggtcagaggtttgctgagtttttctgagggatggtgtatgtgtgtgtgttgcaggcagcacatgtcccagtgaaggtgggaggagagcggggtgtccagccagctgggcccctggccaccccctaagctcctctttccttcccctgcaggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaagggtgagtggaatagccaagcgcgggcctgtgggtttggtggccacctgggacctgtgagagggcagcttctggggagctctggccccctctgctggctctgctggtactgccacctggaggccaagagcaccagccaccctagaagcagcatctggttgagttttgagtgctttgctgctgctgcgttatgcagggcataaatcattggtttcttcattcatcaaatgtttactgagtgcctaccatatgctggggcctagactaggctctcgggaatcacagacgaataaaacacagcctgtcttcacaaagcagctcatttcgtaggaagatgaacaagtaaaaacagaaactggttcagtgtcatatgccaagcccttggaaaagtgtctgacacatagtaggtgttcagtaaatgaccgaatgggcaagagactctgactggtccagcctaggtggggtgcccacccacctaaatagggaagggtggtgggggagtgcagacatgtctggagggacctgggttctatggcaggtgggacagagctctctgggacagggtgaagattagaaagtgttctctgcagatgcctgcagtatggtagctccctgggctcagacgggtctttggggctggcatctctgcagaccccgctgtgctctctggctgccccctgcgctgtacggcactcacgccccctttcccccagggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccatcccca

SEQ ID NO: 5 - DNA, 1122510 bp, Homo sapiens
  misc_feature (1)..(112510): DNA nucleotide sequence of the entire ST6GALNAC3 genomic locus including 5000-bp upstream sequence.
atcatagctctctccagagggtttgtgagggctagaccattagaggaaaaaaatggttcaggcaaaataaactgcagcagaaccccaactgttaggccctctcccctgggtgttcccatcagtcctgcatggatgcatttcaaataccaactttccattctaatcttttagggcagcatgtaaccaggcctcactgagaggagaaatccaagaagagtgtagagaaacacacatgagaggaacctcacaataaaaaggaaacaaactctgggaaacatggttaagaaatatcagactcaattaataatggaggcttcaacagccttggagagatccaatacaaactaaattcaaactatatgccagtgcttctagccatatttactttttttttctttttttttttttgagatgaagtctagctctgtcactcaggctggagtgcaggggcacgatgttggctcactgcaatctctgcctcccaggttcaagcaattcttttgcctcagcctcccaagtagctgagactacaggtgtgcgccaccacacccgactaatttttgtatttttagtagagacggggcttcaccatgttggccaggctggtcttgaactcctgacctcaggtgatatgcctgcctgggcctcccaaagttctgggattatagacgtgagacacagtgcccagtccatatttacttttaattgattatgtttttttttttaaaaaaaaacttagaggaaaactctttaagaaaaacaaatcaggctaaaaactacattcttctaggtaatgaaaagtaggcaaacaacattagttttggattttttaaaaattaaaaacagcttttcttaattggttcatttgaaaaaaaatggaaacttccaatagggaaaggtagagctgagatgaagttaagggagaatgttactgaatgggaaaatatataatattttaaaaatgcaattttaaatcatgcgtaacttgtcttggagttcatcccagataagtatcagtatagtcagggatgttgacgaattctggattagaagaactgtgcaaaggtttgaaatagcagtaagctcaagtcttgggaatgcaaactggatgacattttggaatgtcctactatcgaaaaggagagaaatgaagcttaaccccatatgtcagtgtattctcataaacagctacctaaaagggcatagccaagatgcagttaaacatagctacagacacacgtgtggacctggacagctagatgcctgctttaggatatgaaaaatttcctaggtcacaattataacagtgcaatgatttctagaaaaagaagatcatttcctatcctggctcagaatgttaaaaaaaatgactttcccataacattttctaatggatcttccagtcacagtctcctatggaggcataatttatgtagtggatgacaaagagttttatgatatctggaattcatttaaaatctttagattggaaaaattgagatccaattaaaatcttaataaatgactctgtgttgcatataaatatattaaattaatatgtgtgcaggctgaaattggaaaagttatgagagtcagcatgttaattctatttctatcagggaactaactgtatgttataactctgagaattattgggtaatggggctgtttacaatgaggcaaaactgaatttaaatagcaaatattcacccatgacttgtcataactcatgaagtctccaccttgaggcatggtgaaatctcactagtgaaaggcctctgaggagagggaaggtggaccaggaagccaagaagagccctagggaggctgatgtagtgaaagggccaggtccaaggatctctccatgaaaggaagcaaaggctggcaggctgctctgtggcacccccacgtagtaggtgagatgcagcagtgagaatctttgattggaagtcattctcatgcacagaaggtggtaacagcttggttggtgagagactgatgagaagtgctgggtctttgttaaggtatgacccaggggctgagggttgaaaaatacagggtgagtgtatgtatccggtacactcagattgatagagtgtacctatcctctgcatactcacatatttaccctaggttttgtatcctagtctgtatcccggggaggattcatacttaccctaagttttcctatggctacactaagacaacagatgaaatgtgaagagtgacaaatgacagaaattgggcttctaacatactggacagctgaatgtagcagttaagatggcaaacccacaagtccctagattcaaacccctgttcccctagttaccagctggggatgataacatccatgtggatgttgtgaggatcaaatgagatactttctttaattgcaggatgctccattttgttattattatttttggaaatagaaactcttggctttaagtcacataatgttagagctggaaaattatgctacacctatggatttgactaagctgttcctgtagtttggccagttttaaaacaaaaaaatcctggcaacacactcctatcctcccagccccaacaaatctggctatctccattccctggtaggttcaaaacctgtttttatttccatccaaaagcttcccccccacccccagacatcgagtggtccatctaaaacagtgattgttaatactgttttgtaaatcttccagtccagatttattctagaacttgagtttgtttttagattgttataaatgtgcctttatttctagctgtttgacataacttttggatgttaataaaaaaaataacaccttgggaagtatggacatgggtggatagaaatgtaattgagaaagccatatccaagtagattgagggaattagtaaaggcctcatcacggcatacccaagtcataacatgttaaaagtttgctccgttggtgttcatcctcctgagacacccaaggctgatggcaattatcctattcatcttctcccacaagtctgtctttagcggaagatttttttctttacataaagagctatcatataaaaagtgctcatagtgccagaaattgaggtaaatgcaatttgcaaacattattatctcatttaattctcttgaggatagataatattagataaggtaaggattaaagagaggttaagaaacttgatcaaggacacccagcagggaagtacttagcagggctgttcactagggcctgctgtttctctttccagatgtacagactttctagagagaacgatgtgctctgcccaccctcacccctttgctctgctgttctgccagggacatgcaggagacggaggccttcctcttaaccgcaagaggccttccttttttactaatattcctcagcacagaccctttacgggtgtcgggctgggggacggtcaggtgtttctctttctccttcctgagatctttgcttccaatttggctaaggccctttccatgttatagtatcatgtatctcttattcttgtctttctcacttaactgtgagcccaccttgatgttagatattctgaaagtcattctcctatccctgaaaggtcttcaataaagatttttcctccacttagtggaaggtgaataaagtttattcttccatttagtagtggctcaataaaaaagtttgtggaatcaatcaagggatgagtaaatgaatgaaatactgaattttcctggcctatgaaggaccatgagctaaagcagcggtttaaagtatatagtcccaaacaaagaattcttactaaaaacacaccggatctgtaaggcagaggagggaggggcgggaggaagaagtcgaagagcagggtgtggtattccagggagactgaagacaggagcttcccatgggacaggcagttcatccacaggctcagcttctgcaacctccttcctgtggttactcctgctctctaagaattctgcatgttctcatcaagaaaataccaaattccttgaaagcctggattctgccttgtggtttgtgagccaatctcatgacaccaccagcccacagtgcttttcctgattccatggaggcaaactagacggagcttctagcaagtgaaacttcttttgggtagatatttgggggccgcttttaaaatttttctgacagaccaagtggtaaaaatctgtgtgtgtacacggaatgctctctcccttctgcaatgcgtttactctccttgtagaaataactgcttctcttagccggctcttgcttggagcagggaagagcaaagtcctatcatgtacacatacacagtttataaacatatactgtacaatcaacatgtacatatataatacaatatacacatgtgtgcatcctgtatctgtatactgtatatcatgcatatacaatttcataaacaagcttgtaccaggaaaaggcaataatttatatattatacacacatacatgtatatgtaaaatatgtacacacacacaaaatataccatacagagtgtaaggttcatgacgtctttctttcgttgatatttgtgctcacttattagcggtaaattattaattttagataagcccatcacagagtgaaggctcaatccttgaacagcccagggagaacttcgttgctacttttgaaaagccctttgatgtgcccaaagtctccagaagggcgatgccaaacccactcaactttgacaaagtgtgaaacgtctgtaaaaaggagttctctgatgtgtgagaggagacggaaccgagaagaaaaggccgtactctgccccccgcgggacccaggtccccgcctgctgcagagcgcactctgcgcacgtcgagccgcgaaaggttcacagaagaaaacaagagaaagaagtagcaggcactgaggagccgccggcgccggcgcccaggacggcacgtgacccgggggcggggccgcgcgggccgcgggccagtggatggggacgggggcggggccgcggctcggggggcggggtctgtggcggcgcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaaggtaacgacttggatctgtggctcggacgcgtggttggccagccccttgctgctcagaggcacggagtcagccgcggtcccaccgcatcctcatctcagttgtcttttcctggcattgattttctttttgttcctttggcaaatgcatatggagggagattctgaaacatgcagctggcacagcttcttttcccaccattcctgcctcctgctcgcgcctgcattgaaggagctgcagactgttggctccaggggagagcagggctgtgtgccgaataatggggatggtagggagaggaggggtgttcccgcgggtcccgcggctctgtggagcctgaggcctttcaggggccacggggaggggtggagtggctaggcgtgagttgctggtggtgaggggcatagcgctttaaatggagggaagagtgagcggaggtgggctctactgtgcatttgatcatgtgaagacagaaacttctgagtttacaggtagtcccttaggaatgagttttctatgagatctgctagctctgtttgcccttagctctactttggaaaagttcacacgaggatgtatatgttagtagagaacctctcactctctttatgctcataaatttgaatagacaaaatgattttatgctctgccagagtgcgctcagccatcccttctttgttgagttttctttctccaagaccggattcttagcctcacctgagcatctttctgggttcacagacttgtggcctcaggtgggagaacttggtgtgagggcctcacttaaaaagaactttccatcccactggtagaggcctcccctgccctcgtttttttttttgcactacctttctacaagaacataacctggatgcatgaatcaaaaacatgaacagcatgaaagtttcctgggccttgactggagaatgcagagacctagttgtccaagcctgggggaactgtgtgacgatggaaaataccaggaaacaattcgttgttgttgtgttattgtgaagtagcatttatttctctataagatgatattaagtcatctactgtgttctggttacctgaatcgtcttctaacgtgcctggtgtcaatgatgaaaataagagactaacctcgtagaagttgtttccccttctttgcgtaaaggagatcagaagtttcctgtgagctttctgaacttcctctttttgtttcagaacattttccaggacatgaggaaataatacatcagtattacagtatggggtatttgaccgggaggctcttagcacaaggactgaaatatgaatatgagtcatctttactattcattgtgttatttgctgaaagggacattgaggagcatgatatttattgctggccatctttttctgttttggtttctcccctgccttgtcctatacatgtggtaaacatctttaatgcacatcccaaactacacatgaatctggtccaatctttctcttctagcacttcacactgctttcagacatttgggacatatctgtccaccttatcttccctccactgaaactaatgtgggctttagactcagaaagatatgtctggatgctggctctgcccactgctacctctgtgatgttggacaagttacttaaatgtctctgggccttagtttcttcaatataagatcaaagtagtggcacctgcttcacaaggttgctgtgggaatgaaataagatagggtatgaaaaatactttgtggcacaggcatttaatatgtgccatttttttcctctaacatataataataagtgcagtttggttgatccttactatatcctcagtctgtttcttataactattattttttataaaatacaaaatgttttttattctttaatctttacataaaaccctgaaagataagtatcattgttttaaaccccattttacagatgagaaagttgacgctccctagtttaagagatttgcccaaggccacacagggttaatgacagagtgatcctggatttagacccagatatgtcaaccttccatatactttactgctgttccagtactttcccaggtgatgacttttaagatggcctaataccattcagttccaaccacctttgagcacctttgagcaatccccttctctggtcatggtctagacagtctgggctggatcttttttctttgttgtctttgaaaagctacacatggagcagtgcagaatacaggtttcagtccagagacctgagttcagtgcaagcctggcttcttgcatatgattttagacagctgctgcaacctggagcctcagttttcccttgttgaagtgttcatagaattataaccattgcgttacagggtttttatgaggataaaactatggacttttttttttttaatgaaatattttctgccatttgctgaccctggacttggtgttggcatatgtagaaaaggaaagattttcctctgccctcttagtttctgtgcctggtcctgatagctaaactgacaaaaggcatattaacagaggaaaaacatacacattttatttgatgttaatgtttttatgtgtaccacagagggcttcctatataagaaataaagacccgaagaaggggagaggcctgagagtttataaagcattttaatagagaaggataaattgtggaaatgtgacaagacaaaggaaaaagggggtttgggctggggcagtcgattgtgagaaagtgggaaatgtatggggaaaactaatggaaaataggtgagtgtttttactagagatttattttggtgttgactctccatctttgatcataagaatgttctcctcttcctggcacagggaagggacatttctcatgggaaattttatgccttgcttttaggtagaaatggggaggtcagaaagcccttcctgtatctgctttttctcaattgcctttagctcaaaataatcaatatgccaaagtgatatattttggggtagcctgttctgattccttttacatcacaagatgcataaaccattgaccccattctcaaatggcttatggtttagtaaggatgatagaaaagtaaatgagtgcttaggttacaatgtgaagaataaaactacataggtccatggagggcatagtagaagcatggaaggagagagcaattacccctgtcattgggtagttcagacaggcttcccactgatgatattggagttgtgttttgaagactaaataggatttactatgacggagctcgtgttttagaaagataagttttgaggcagtgccaactttgttctgtgggctaagactttaatcttctcaatgaattttgcagtagattttactatccatttttacaaatgagaaaactgagatagagagatattgattaaagtatcattattgcctacacaatagtgaccctcactaagaagagacccccatgctgtggcagctaattttggtcttttaggggatatggaactatcccctcaaggtgctgtgcatgctgagggcccattctgccaatgcatagcgctagttctcgtaacagaacgatgatcacttcataatcatttaatttaggaattcagacttcacattgcctggactttaaagccagaaatatgtgacttttaattatggctccactccttattgattatagagccataacaagtttcttgatttcactacctcagtttccaaaatgggaatcatgcattcctcaatgggttattctaaaggttaaatgagataatctgtatattagttatattgcagggggaaaaaagaaactctgaatcttagcaggttcatttcttgccatgctcctggttaggcagctctcctgtgtagctctaccattgaataaagaatcaactcaaggaccagtctctttattattattatttttttttgagacagagtctcactctgttgcccaggctggagtgcagtggcgtgatcttggttcgctgcaacctctgcctcctggattcaagcaattctcgtgcctcagcctcccaaatagctgggactacagctatgcacccctatgcctggctaattttttgtatttttagtagagacggggtttcaccatgttggccaggctggtattgaactcctggcctcaagtgatctgtgtgccttggcctcccaaagtgctgggattacaggcatgagccatcgtgcctggcctaggaccagtctcttttcattaagcagctctgatgtcttcttgggccccagagcccttgtcagattctctgttttcagcagctccaggagacagattacagggaagatctcgtggggttgtttaaaaagtctctcaaatttgatagacaggaaaactctttgctttaatttgtatttatttgatcattagtgaagttaagcttttaaatttgtattagtcatttgtctttcttcttttataaattatagatactttaaaattttatgcaagaaaatctatccatattttcttttatgatttctacccttggtcagcaggtacattttcagcacagtgtcttgtacactttcatttttaaaaaatataggtgaattgtattaacttttatattggaagtggacattgagtggacatgtagacacaagatccttgagaatcatttctgccttcgagaagattatggttttgccaggttgatgaggcttatgaacatgaagcagttagctgatacgatagatgcatgactaagccacaattaccttctctccagtgacctgtcctcatatatttatcttgattgataggtaattagatgaatgatgataccaagttaggaacttggcgtcttctcatttcctcttcctccccctgccccagatctaatccttctccacagtgcatcagttctgtctcaggaaaacctctcaactctgccccttactttccatccttactccccctgccttgttcaactcccactttagagtcacatctgtggtcaggccatcccctgcctcagcaggcttcctctgtgctcctgtggtcttagttcttgtccctgtagtagcaggtattaccatgtactgtcaataaactgctttcatgcccagctcttctttgactatcaaatgttagggagccgcggccttccagtgtttactgagcatctgtaattgagttctgttcttaccctaagtgagattatagactcagtgagaaggcaaataattaaactagtaattaaaagtatgcgaggagtttgaaaattacacctcatggtatgggagtatatgggtggggtgttgacggttactgaactgaatgtaaaaggcagaaaaggctttgttttattcaacttggtatttctaagaactagcttggctctcagtaggtgatccttaagtgtttgctgaatgtatcagtggtgttattaatttttttttatgtcagttatagacacaggtccaacctgtcttctgaaaacagctgagcatttcaaggatgtggcatggattttttactctaatgtatagcaggcagattagagcttgttgattagtttgctccttaaattttttcttagtatgtttcttgtaggtaggtctgttaccattcctcatataaaatctggggccaatttaagatctggggttggggggatggggagatgagagaactggactagaaggagggaaaaagagaagtgtaggcgtggtttaacttttgtcatgatcattttggttccccagattaacagaaacagataaaccaaaaaaaaaaaaaaacaatcaaaaaccaaacacccacaaccaaatgattgtgtggttctcaaacgatgaggtctcaaagcatttgaaaacagtatggcttcactgagactggaaagccacagggacttcacaggtacacagatgataaatctgaaaccgtaggataaccctggcaagtagacaagtcacttcatttaataaatctgctatgacatttcttattgctgcccaggaaatgctgaattctcagcagctgcctggcctaatttccagtcttacagtgactgagcagatgcttttgctacgtatatcagcacattgtggggaatgagtggcttgggtaaaagtagtgctctttggatggattgataacaacagcaacaataggtgccatttattgaacagccagagtgctcaggctggcttctgtgctaagtaaacttttattacaaatgaagacactgaagttcagaaaacctaagtaaattgtccgatgtcctgtggtcagtaagtgatggaggtggggttcaccctgacttcgtgtggttgtaaagcaggggtgttcaaacttttggcttccttgggccacattggaagaagaattgtctgggccacacataaaatacactaacacgaatgacagctggtgagctaaaaaaaaaaaaaaaaaaaagcaaatcgcaaaagaaatctcataatgttttaagaatgtttacaaatttgtgttgggccacattcaaagctgtcctgcgctgcgggttggacaagctatagagcttgtcttttaccttcagtgccaatttagtaaatatttatagggattctgaatttatttcaccatcttctaccccagacaatatccagtctagacaacttcctaatctggtggcctgatggggaccacttttagctgtgtcgtttttatttgttcctttaagtttcctttgtgacagaagaactagaggaactagaggggctgcaaagactgaggagataagaaggctttaattctgtttaattctgaatagatctttgaccctgggcaagttatgtgaacctatgtgtcctttttgggggtgggagtgagggagagttggatttaccctgaacgcaagcttcagggcccttccaaggttctgggaagagacactagcattttggtatttataattttatattcattttatcaaggaatcccacaaatcgtatacatttcaggctccccaacatagatctgtcccttgggtggtgttggagaaccaaagagataatgcttgtgaatgcactttgcaaagcagagtgcactgcataggcatgaagtggaaatggcaaaaaacgttattagtattattagtactgataatagctggaatcgaggaaacctttgttgaaggactagtgggagaaagaaggggtttaggtctgaggaaaacagggaagcctattaagctttctagtaaacgactgagcgaagttatgaaagcttctccccaggagaaaaatttctgtttgtaagaatttaacacacacttatgcctgagggctgggagttgaatgaggttcttttctgtttcctggctttagggaacagtggaggaaggcatttttctaattggagggagtagatttacaagtgctacctggatcccattaccaaaagctgcagttagctcctggttattaaaaggctcattattcagtttatggattatccagaccccatttgcctccagccattctgatgtacacgttttatgccttttactgccaattagcgccttcacctgagcagagaaaaaagggggtgctaaaccccaaatttgttaatttctctccttgttagcagctctgtaaaggtttgtcagcaggagagtgggcctaggaaaaggttcaaatgaggtgaagggattatctgcgctttctctattgctgtttctctcaattcaaaaattgagactaggctctggttctgactgtaaactgatttaaagtcactaagtcagagaccttggcctgggatattaagagactttaataaacagcagccctagggtaggtgacattctttgagaagccccttaccccacactccatatctccaggcctctctttcatttcctgtgtgatgtggaggtgtgggggccaacaacatctggtacttgagagagtgagggagaatttactcctaaacagatttgtcggaggccagaaaaagaggatacttgggtcgttttcgtgttttttgtttttttttttaaaggtgtgtttctctgtgcacacatagcaaatataaatatacatgcacattcattcaatcttatcttaatatttactcagatttgaaaactatcgcacgtaaaatccttttctggaagggacttctctctgatttcaaaggctatttggtttcttagtgaatttattggctgtgcatttactacacacgaagtaaaaacttctttggtcagctatggaaacgatttgcatcttgctctgagaagatcatgatcacaagggaattggaagtaaaatgtgtatattctgggttggaaatgagtcctgatctgggattaaaacctggttgcaatactcatcttagattttgagaactagaatgagcaaatgactgtcgtgagttgatccctctatttgggactagtgggatatgcacttgcggtgagcagggctgtgattcctggtgctgtttgctgcgcggctggccgcgacaatgggctggactcgaaagaaagagaagtgaaagtctctctttgtgaagcgtttgccttatcagagaaagtggtaccagagaagagacacgagaactgctctctagggtgtgggcagtaagaagactgtggggtgcagaggtcagagctagaccgactctgagtcccatcctggctttgtgattaatatgaataaaacaataatacccttatttcatggtctgtagcagtgctgtccagcagaaatataatgtaggctttttatgcaattgtacatttcctaagagccattattttaaaaaagcaaaaaagaaacatgtagaatttaataatgtgttttatttaacttggtatatccaaaatactttcatttcaaaatgtactcaatataaaaattaatgagatatttatatctttttttttacaaacagttcttaaaactcggtgtacgttttacacttatagcatctctcagtttgaattctaaatttttcatcagaaatatttgatttgtattttgattttactaatttaaagtaaaaaagtaggttcactcgtctaagttgaattgtgcttagaccttttccagtagctgaatggaacattatttttaaaaggtaaattaattaaaatgaaatgaaattttaaaaatgtggtttgttggttatgccagccatgtttcaatgctcaaaagccacatgtggctagtggctactgtattggacagcatgctccttcaggtattcatcttcactatcagaagagaccactagactcagacaatgagagtagcgtaaggggctgcagaaaggattggctgctgggtcaggttcagatggggaggacacacctgttggctggactcctggcagccaaaggctggcgactgatgagcaagtaatgagtgcctgactcagggacacatctgagcgtttgatgagcccttgaaattttatctgaaaatgcagtcctcagtttcaccatatcctgagcctaattttaccccagatgttgtgcagctgtgagttttcccaagggagtgctgctttgtggtatgtgtgagttggctctttggtctcagtgtggtagtgtgaactcctggaggctttgagggcagacacagacttgaagcacttttatttgagttgtttcattgctccaggagggtattacacatatgggagcaatttaaatgtccagaacaaaccacatgtcttcttttaagtccagagagcaaggtgattgcagtttctttgttcggtttgcttattttttactgcttatttctgtgtgcataaattcagcgacatgctaatagacatatggccaatggtgcttagagaaaatctgtttgtaaacctgaatctctgttttgcctacacatttgcattgtattcctgccctgctccaactcgttgtcctagaccatccagtgttagcatttttctcatgagatgaacatttcgttataataatgacagtagctgtcatttgctgagggctttctgcatgtcaggcagcctactaggtagtttacagatatttattgtctcacaacaaccttcagcatgggcaggattggtttcatttgacagatgacaaaactctggcttgacaactttaccagcatgagagtgctagactagggtcagcaaactacctcctctagaacaagcccggcttgctgcctatttacatgcagctcctgagtaagaatggcttttgtgtttttaaatggttgaaaaaaaaatcaaaagaagaataagagttgacaggtgaaaatgatatgaaattcaaatttttcacccataaataaagttttattgaaacacagccatgcttattcaccatatctgctttcatggcacaaaggcagatttgagaagttgagatgggtactgtatggtctataaggcccaaaatatttactacccatctctttacaggtaaagtttgccaacccttgtgctaggctgttgagttctttcagtggactttaagaaccacagtgaagagcagtgtggttctttcatgtctggccagcaccaggcctcatgcctcacactctgaatggtggggatatttactgagcatagagctaaatacggtacgtggaagaggagactgaagcttagagaggccaagtgactgcccaaagtctcatagtggggctggaattcagacccaaagtctgaactcctaacagttatgttgacctcagtgctggaaaacttgaactacatcaggaccactggaagggacggttgtactagagtttgctaggccttaccactgtttctgattcttccagtctggggtatgactcaagaatttgtatctctaacaagccaccaggtgatactagcactgcacatctgggaaccgcactttgattagacctaccatatgacatccagctcaatgaacagttgttgagttatggaaattgcagagcatggattcaaacccatgcattccccaaaagaaattgactagaaatttaaatcaatttagcaatttaagtgcagtgtactccagtcaactttcttggcattgtaataatttgatttctgccttcattgttttcattaaactcaagatttcttctgatgctatgaggctcaggccactatgcacactgaaaaacttttgcctttgcacgagctaggggctgggactaaaattaacccctcactggtggcaccacttgtgtctggaaaaatcagtttgtgattatttctaaaccaaggaattttgttcctgctgattgcatatcaaatcctttctcacactttggaccccccacttctttgctggctaacagggagaattaggggtgcaggaaacagctttcacagttagattatgctggctttggttacaaaagttaatgcattagtgctagagttcactatcttaattactgggttagtctcatatttaaaaagtcattatttaaggattaggaatggggaaatcgaagactggtgaaagacgatagttttttttcgtgttgatgattcatagccttgttttagacttttataagtaataaaaagcactggatactgctgatttagtctcttcctagaggctcatatttgtgtaaagaaggaaattactctgtaagttttcccttttgctttttcctggctctctctttctgtgcctttgtctatattgaagcctatttttctgatgttccttcttcatctccagccttcatgccccttcccaatacaggtgttgcagggatcgttagctagaatgtctaaggaaccatactatcaacccaagagaagggaagcttggtgaactcttaaaaccaagtagatgaaaccttcttgcagagtcccgggatataagccattccattaggaatccttccctgggaaatatgaatcattgctatgcctgatataaaatcactgacatggtgttcatgacagctcaccatgtcatccctcacacctttgccatggcctggaggctgactacactactacttgtgtttgttcttttattgctgaccttgtcaaccaggtcattctttctctcttcctatttctaagagaaaattcattccccagaaccagcaagtacctgaaccattgccactttatatgtgctgccttatttatttttcatctcattctttggctgggagtaaaagaacctttctctcctaccctggtttatgttgcctgattatctgttcgtcggctggtttgatgtttatttaattctgccatgctgcttaaccttagaagcctggttttgtggcttgatttgagccaagatttctgcatgtgacttctaacttgtgggtaaattaaggtttgtttttctctcacccatctttgacccatgatattaaaacgttatttgaagaaaggacatccaacccatataccactctaggtttctgtgttaaaactattgaaatccactatacattatttcagatttatgtaggttaaagggatctgggtttgaccttttccccacttatcttcagcaaatagagacatgtgaagaggaagtttatttatcaagcacttatagagaatctaagtactgtgggtaagaggaggggtagagagaatggagataaaagattcactgaacatctaattttttttctaggggaatttagggtgtgtatgaatagtaataataattgtaacaatagcttacatttactgagtgcttacctgtactgtgttggggctttatatttgtggattatctcattttatccccacaggctcatgaggtacatccacctaggtgaggaaatgaaggcttggagaggctaagtcacctctcaaaggtcatactactagtagaagaggggttatactttgaatccaggtgtttggctgaagtaaaatacatttcctagagtatattactcagatcatacatagataaacctatttgtaacttgcccatgataataataactttaatgatacaataacatcagcaaacattttctggacacttactatatgataggcactgtatttaattcatacacatgatttattttaaagtttaacaatcctattagaaatctattttatctgaggaaactgaggctcggagagaacttaagttctttgtctgaggtcatgtggccagtgagtggaacacctgtggggtcatattatttgtataattgttattgttattagctaacagttactatgtgcagtaaggactaggcattgttctcagcactttacatttattaattcacttaatcctcattttacaggtaaggaaactgaggcacatagtggttaaagttacaaaactattctgtggcagtggtaagatttgaacccaggcagtttgaccctggcatctataacagatgcgcctatgaccacagactttgtttcctttgccactttggtggtctgtctcctagagcagagaatcactagtactattacaaaccattccagtaacaaattaacctacttaaaaggagcttgcggaaatgaaaatataacttgaattttgacttgaaataaactgaactttaaaaatcctttgaggctttttaaaaaatgtatttgaagaatttccaatcagatcaacttaggaaggcccacttaggtcaaatcagacatggaggaattaattttcttgtggagctggtgttgagcctaagtccatcgtgctgcctgggtggggaatgccaggcagctttccttctttgctttccctgttctctcctcaatcactcatctctctagataaggccacagaacagccagagtgatcttttaaaaagtaaataagatcatggcagcctatttgtttgttgatctgtcagtcaaaaaactaaaaggatcacaaaaaaaactaaagggatcacaactgttttgcttatcgctgtgtatctatcatctagcacaatgcagtcaacaaaagaatgattaaatgaattaattttaggcaaaaaaattagcatgtgcaaagatccggtggcatgaaggaacaggacattttgggaaacagtgaaaagttgtgtatggctggcattgagctggctttgggagctggaagagataatacagttgggtcagatcataaggatcatgtagattctgtcaaggagtgtagatttgatcctctagaaatggggaaacactaaaggattttgttttttttgaggtggagtctcgctctgtcacccaggctggagtgcagtggcacaatcttggttcactgcaagctccacctcccgggttcacaccattctcctgcctcagcttcccaagtagctgggactacaggcacctgccactacgcccggctaattttattttattttatttatttatttatttattttttagaagagacggggtttcactgtgttagccaggatgatctcaatctcctgacctcgtgatctgcccgccttggcctcccaaaatgctgggattacaggcataagccaccgcacccggccacactgaaggatttttaaacagagtccttgggttggctctggccattgtattttgtatttggaaattatttgtctcaatgatgattttgctacaatgattgcacacgggtaatttcaaacagaactttaaaagttaaaatatgctaaagatataagtgtgcttgtttatgacagagcttggagttgtatgtatcaaaagggtcaagccaatgacaacataactaaacattttatacaaataagttattagttgtacaggttgttaaattttccatttgatgaagggaatcaagtttgagcattatctcttgggtcatttagacgatacattgtggatttatggctccttttggtagagtcaactcttgacattcggttgacagtattgcccttaaggaggatgctaggtggtccttccctcagagtcactatatagcagctgtctgtgagtcctgccttggaaagacaatattattctttcagcagctattatttattgagcacctacaatgtggcagatgaactaatcatcttaccttatgtgagtaaactttatagcatctctttgaggtagatgtgtccccattttataaatggagacactggctcagagaaggtaagagtaagttagagtgcacttacatacacctgggtgtgcactgagagtgtatttatatacacctagaagttaagaataacttatctgagccacggtttctccattgtaagtgctagtggggccagggaataaaattcagatctgtctgacccaaaataccttgcttttaaccatctggtcttctacctctgtagaggagagaatcatttaggaaggagcctatggaaataattttgatctgaattaaactgattatcttttaaaagttaaggagttcttagaacttttctttgatgttaagaacttttaaactagattatacttaagaagacaatttatttcacttgcttagttcaggtcagacctggtggaattagtctcactgataagcagatacttgaacagaatcttgatgaataagcatgagcattaacttcagactaactggccggatggctgtgcctcctggtctacccacctactgctctccctgccacaagttcctcttcttcatttgtcactcttttatctgttcttggcacagcaaccagaaggaattttaaaagatgcacgtaagatgatctcattccctttcttatctggtcagtggcttcctttttcatttggaatatattacgatctttgaatcatgactccacaggcctacaggatccctttccagtctcctccaaggcactcagcctcttattattttctagctactctagggtcttttcaggccctgaatctgaaacatgacatttgtggaaaatgatgggaagtactttatggctaaagcttagtctggactttgggggctggtgggacattaggtagactaagggtttggacttgaccttgtaggtaatggaacacttttgagacatttttagcacaaaactaaacgtaatggagccactgagctgaggagtagaatattcttctattgtctttttagagtgctcagagtccctgcattgccactggtcattgccctttgtacttggaaatgacttgttccaattatgacagccttgcaattgcgcaggccgaatgtttatcagaaaactgtaagttaaaacatggcaatgacatctctctccttgtgtgtcatatttaaggcacatgttctctgaaatcaagaagctgggctaggatcttgcactggccccagaccatattctgttgtgaccatgcttcagtgagaatgtgtcacgtgtaaaatgaagataagcaagaatatcagtctgtttgaaagtgctaataaaagtaaaatattcttggcaaataaagctattaatgtaggtgttgaaattttcatttagtcagagcagtcctaaatttaaatgtaaccttttgagcccttagatcattgagttaagactctttctcatgcggatgaacagtaaatgcttgttatctgaagatgtaaattgggaggagtaagggacttctgccccattgtgcattaatgcctactgtttgtttccctgacttagaatgtggctccatatttttgccctcaaggcagctattgatggagtcatcctatgctccaaaccttgagctaagcaccacatatagtcatgtgccacatgacgacgtttcagtccagtcaatggcagactgcctatatgacagtggtcccataagatgataatatcacatttttactgtatcttttctgtgtttagatatgtttagatacacagatacttaccattgtgttacagttattatacctatagtatatagcacagtaatgtgctgtatgggtttgtagcctaagagcaattggctataccatgtagcctaggtatgtagtaggctacaccatctaggtgtatgtaagtgcactctatgatgctcacacaactacacttacggatgtggttctcagaacatatccctatcattgagccattcatgactgtatgtatatgtcagttaaagcttataacaacactgtgaatctgttttttcatcctgctgtgagtttggattgtttatgaggaaatgcgggcttagagaatttaattgcttaaagtcagagagttaggagatccttcagttttgactgatgtcaacctccgtgctcttaaccccagctctgtccaagtcataagaccatcctatagacaggccagaatggtacaagtggaaacacaggaagagatcttctttcctatagaccttaaataaaaatgtctcttggatcatcttgtctgaaagcccatctttttgggtttatttctctgattagagagatactttgttttgcctaatacgtatttttagaaagtagtacaggcatcagtcttttgtaaactctttgagatttaaataaggaagtttgctgtttgaaggactttgtggctaatcccttggtaaagaagtatcttataattgactatgaatgccttagtagctattctgtttcataacttgactttcaaaaaataataatggcaaaagatgacattttttgataagcaccaggtgcttttagaagcaatttttatgggagtttctaatctaatcatcacagcaacccttcaaaatgggtgctattattgtgtccatttgacagagaagtaaactgaggtgacagtggctagatgcagggatggcttcgtggcatgtgacctgcatgatcacacaggaccccatgcttagaagggccccatgcttggtgtaatattctgcaattattgtcgtagaagacttcataattttgaacaagggccctgcatttttattttgcatggggcctcataaattatgtggttggtcctgcctagccaaattgtccaaggccattccatggtgagcagcagagttgaggttcaaacccagactgcctggcgtccagcgtgactgcctggcctccagagtgattgcctggcctccagggtgtgctcttccattgtgtcctcctgcttcccatattcccatgttcttaagcactgtcctccatcttgtttttctctggacgtgtctttagaggcagaggcaggtggtttgactcatgtctgttgaattctaaagattcagaatttatttgttgaactgaatgtttgttacatacaatttcctaattaagtttgtgggagtgcagtagtaaagatttgaagatatgggaagaattgcatatcctggctatagtgaaaaatcatagtctaaaaataaatgggaataaagtggaaacactgtaacatgtttgctttgtacagctttaatggaaaaaggaaaggaaagaatacatatgaaaagaaggcagtcccttggcactgcctgtctcaatgctgtgtgctgtggactggggacacttaattaccacgtacaattttatggactgttcatgagaagcttctttttaacttttcatggattgcagtaaaggaaaatatagaaagatagaagaggattttcatcacgttggcaagaactgttcctccatgatctatggctagagcctgaaactgcccaagttccatctctcagcattttctgagaactttctgtgaagagaagttcagaggccagtaaaacaagtgtggtcacgaaaggaatcagaacatgactcccccaaatctgcctctttgacataaaattatttttgagctgaaggaaattaagaagcagtaaacaggggaaaagctctctctatcctccccattttctgcctgaagacaggatataaatcctcctctactggagacaactctagactcatcagctgagagacaacgccagaggaatctgcaaactaacctcacttcatcagttttctcctgtatatttaccttcccacagtttcccatccttggaagcccaaaacctcacttctttgtcctgtcttttcttgacaactttattgttctttgttgaacatgccacataagccagatgccacataagccagagttctaagctgctgctgtgggttacctttcattgaggtttctcctgtgtgatgtacactgcatgcattcataagttgtttgttttacttctgttaatctgtcttttattacgggagttcatcccaactaagaacttatgaggcttgggggaaaagttatttttcctccctgacagtcactgcagggcaactgacgttctgacagagggaggcatctgccacaggaacacgaggaaagcagctgatagagtcaggaggagtctagaggggtcaggggaattgtccatgtagagaagagggacagagtgttcatctatggagggaacagtaaggacaaaatcacggaggcgagggagatcacggtcaagatgaactgcagtatttggccctgggggaagtgttagaaaggtaggtggggaccaaatgctattgtgctaagttaaggagtgtggatttatatatcccaaggcattagggatggtgatcataatagctagcatttattgagagcttcccaagtgctaggcatgatttagtcccataatatccttattctccaacactcctttggggttagttactaatctcattttacaaagaagaaaactgagggacagagacttttaataacttacctaaggtcacacaactagtatgtttcagagccgggattgtgaactgggaagtctggctccagaacctgtgttcttgatggcaattttatactgattccagtgatggaagaattttaagtagaggaaacgtgtatatgatttacatttccaaagattgttctaatggaagtgtggcctgctaggtgcaaggagatgagcatctctggttttgccaccacagaaactatgaagacatgttctttaaaaatgacttctcctctcttcccttggtatatgggtgcaatcaattcttgctttaaataccttctccctgctctttctatctctgaacagattcctcacccccaccccccaccgttccttactcactgagctttatgctacttgaccatcactcaacatcactcaccaacctagccttctttcttcttcctcttggtactgctctctagattataaacatccatgtgatttctggtcacctgtatgtatacctattaggtgatacgatatgtacactcagtggtcattattaatacatgaaatggctgaggactctagaggcatgaatggagttagagtcctttctgtgatatatatacccctgggatctggggggcaggcagcaaacctctttggaccttagagacaaactgggcatagtaatcatatctgctgtactggttgttgtcagaaacaaaatgaaataagatgatatactttgtataaataatgtttatacaaagtataacattatactttgttatatggctacattgtctctagtgtaagcaattttatttacaatttgtactctacttgttttgatatcatttatggcaactttatgtattatagcatttcaaacctggagggatctaggcagactgtggttgattagttgatgtttagaaagactggttaattcactgccagaatgcagatggggtggttggggaggataactgttttctccaggcagtgggtcagactgttcccaaagtgtgatcttacccatatcacttaacctctctgggcatctgttacctcctggaaaatgaaggcaaagctgcctacttgtagggctgatcatgaagaagattgagatgttttctgtaaagtgcttggcacttagcaagtgttctataaatactattattattttcattcctgaaaaggaaggagttagtattctagtgttgagtgtcaaaagactgggggaaggagtgtgggaggggtttatacactttccttcccatcctctcagttgtcctccctcatctccactccctccatctccaatcttttctcccctcagggctgaatgaaattgaatgtcttgtaaacgtgtgcagcctttgccaccgggccctcggacatgcccttttaacattctgacataatggatgaaaacatgaacagctgacagtcattggttaaatctccaaacttttcattccctcacctgtggggatggtgccctctgcctggtgaacccagcccaggcagagattgcaggagctggctctgctggtggtgggcctggttacctaggcaacgtttacctgtgctgatgacaaagggcctgtcactgcctcctgatgcatgcagaagaatattaagtttgcggggagatggaaagaaacaattttctcttgaaatgaggtagatgcaggtgttaatttctttggagtgaattttctgttttcagagaggcaagggtagagcttaaacacaaacttctggctgaaaatatttagtttgcgaacctggcaagcctcttaagaaaaaaaacaatcctggtgccgggactgttaggcttcctgtcttttcagcagcttattgcatttgttttactgctttgaaggattggaagtctctgaaggccatttctttaatgacttggaatattaatgtaaaaacttgcttgttggacaatacagtgaatactatagctttgcctctaattggcttttcagtccttcacgctgtaaagcccccttcttttaagacattttctttattttgaaatatattttatatttataaattttatttataaaatatctttattttataaataaattaataatgaaggaaagtgcaccaaacaattaaatagcccaatgatttatcatgaagtgaatatattgatgattgctgccgttaacaaggtgaggacagaacatcgtaggtgtcccagaaacagtccttctccccactttcaacccttcccgtctttcactctcccaaaggagattgctgtcttggctttccaaagcaaataaacgaagttcttactagaggttttgttccctaagtgttcatttctaaacactctagtttagttttgtttcttttgaatttcatgtagaggaagtcatagagcttttttttttttttttttgagacagagtctcgcttttttacccaggctggagcacagtggcgtgatctcggctcactgcaatctccgcctcgcgggttcaagcgattctcctgcctcagcctcccaagtagctaggactacaggcatgtgccaccacgcccggctaatttttgtatttttagtggagacacggtttcgccatgttggccaggctggtcttgaactactgacctcaggtgacccacccaccttggcctcccaaagtgctgggattacaggcgtgaaccactgcgcccagccagagcattgttttatgtatggcttctgatatggtttggctgtgtcctcactcaaatcttatcttgaattgaagttcctataatccccatgtgtcataggagggacctggtgggaggtgattaaatcatgggggtggttacctccatgctgttctcgtgatagtgagtgagttctcatgagatcttatgattttataaggggctttccccctactttgctctgcacttctcttcgctgctgccatgtgaagaaggacatgcttgctcccccttctgccatgattgtaaatttcctgaggcttccccagccatactgaactgtaagacaattaagcgtctttccttaataaattacccagtcttgggtatgtctttattagtgcatgagaacagactaatacagcttctttttttcagtgttatgtttatgaagttcatccatgttgtggtgtatagctgtagttcattcatcttacttgctatatttcattataggaatattccactatttatctatccatttggccattgatgcatatttgagatatttccagtttttagctataaatactgatgttgtgaacattcctgtacctgtctcttggggcacatgtgcatgcatttctgttggttgtgttcctagaagtggtattgttggggcataagatatatgttatctttggccttagtagtataaaaaggttttgttatttttttttttaacaaaaagcaaaataattgctctcatacaaatacacaatgaacgtgtgtgaaagatgttatttaactcattaattaatgagggaaccagtacatgttagcagctggttcaaaggagaatggaaaggtccatgtatatgtaggcaataagagatgaggaaatgaatttattaataaaagtgaaatgggtctatccacaaggcaataatttgttgcatttccaccatacatattcacttgcgtttctatggacgggaagaatttgtatcattatcagttttctgcaacttaaatagttgtagaatagcagaaagacatagaaaggcatagtaacacagtagggtgcattagactgcacgatcacaatgcttttttttcttccctattctaaatctttcacaatttttcctgatggtagatattaccaacctgttttccaaaattagtgtatcaaattactcttccaccagaagtatcacagaagttccttttgcttctggacaacaattggtttaaacttttgccattctgttaggtaggcagtggtatctctttgtggttttaatttgcatttccttgattaagaatgaggttgaacaccttttagatatttattggctatttgaatatcttcttgtgtgaactgcctgtattagtcttttccccatttaaaaaaatgggttctcttttaccttttaggggggtaggagtgttttatatatattttatgcattaatatatattttccaatcatatgtgttgcaaatatcttcttccacattttagcttgtcttttcattcctttactggtgtcttttatgaacaaaacaattatactacagcctattttcttaattttttattttacaattaataattgttaaaatccctccttaagaagtctttcactagtttgatttcttgaaaatattttagcatattaatgtctagaaactacattattttgcctttcaaatttagatttaaaatctatttcgattttatttttctgtatgatgtaaaatagggcatcattttttaccccaatatggtatccaattttcctggcatctttcattgaaaagactgtgctttcgctactgcttggcagagacaccgaaatgttcatatgtttgagtctttttctggatatgttgctaaattctagtgatccattgatctatttgttcattttaataccaatgtcacactgtagttttttatgataagttttatgataagtctttatttctgatagagccaaacctcccaccttgctgtttctctttaaggtgatcctggccctttatacttcctttgagttttagaattagctcataaaattccacaaaaattgtggatcttatttactgagtttttatttaagactgcattgaatccttaaaaattccacttctaggtatttatccaagtgaaatgaaaacgtatgtccacaaaagagtggtacatgcatatattcatagcccctttattcgtaattgctccaaactggaaacaaccagtatgtttataaaatgtaaaactactaagcaatgagaaggaatgcactgtcgatacatgcaacaatgtagatgaatctccaaaacattacattaagcaaaagaagccagacatgaaagagtacgtaatacgtgattctatctatatgacgtttataaaagccccaactctacagtgatataaatcaatcagtggttgactgaagtcagggatgaagtgggcagattagtgggaagagctttacaggggcatgtgggtatcaactggggtgatgattacagagatcactaaaccacatcctaaaaatgtatatattttattgtaaataaataatactttattaagttttcttttaaagactccattaactccatagattcgtttaggaaggactaacatttttacaaattgagtcttccaacctaggaatatgttatatagctccaagtactattgcatttcaattctcacattaatattcttttgcttttatgtagaaatttttcatatttttcaaagaaatatccacttattttgaggtattgttaagtatttatgatacaatggaaattaaaaaattaaatttaattttgtttatagctggtttataaacatgtagttagtttttatttactgaaaattatatccagcaatcttgctatattgacttattaattttatctgtagattctttggatttctacatccacaatcatatcatttgctaaaaatggcacttttgcttcttcttttctagttgtgttatcttttatatctttttttacctgattgtactgactccaaaaattaatacgatgttgatatcaaagagaaagttgtcaatattttatcactgtgttaggtttgcagtagtgtttttatagatatattttaaaggaatttcccttctattcctcctttgctaagaagttttattcattaatggatgttgaattttatcaaagctaatcttgcatctattaaaattattatatgtattttctgcttaattctgctaatgtaatgaatatttgtaaaatgttgaacaaccacgcatttctggaagcaacccaattgggtcaagatggattaacatttttatatgatgttatatttagtttgctaataatttgtttaagctttttgcctctatgttcattaatgaattagacctgaaattttcctttctcataaagtccatgtcaggttttggttatcgaggttatgcttaaagtgagttaggaaatgtattctcttattgtttggaggtatttgagtatgatcagtattgttttttctttaaagttctggtagaattatctggggaagtcatcagaatctgtttttttttttttcctttgtgggaagttttaaaattatgcattaaaattttttaatggacatttttttaatgccagttttagattcacaacaaaattgagcagaaggtacagagataacccatataacccttgccccatccgtgcacagccttccctgtgaccaagatcccccatcagggtgctatatttgttacaattgatgatcctaaattgacacatcattatcacccaaagtccatagtttatactaggattcactcttggtgttgtacatcctatgagttttggacaaatatatccaccattgtgtcacgcagaatagtggtactgccctaaaaacactctgtgcctgcctatccatccctcccttctaccgtaacccctggaaaccactgacctttctttctgtctctatagttttgccttttccggaaggtcatatagttggaatcatagagtatgtagccttttcacattggcttctttcacttactaatatgcatttaagtttcctccatgtcttttcacagcttgatagctcatttgtttttagcactgaacaatatttcattttctaggtgtaccagaatttgcttatccattctcctactgaaggccagcttggttgctccaagttttggcacttataagtacagtttctgtattcgtaaacacagaataaacacctatatgaagatttgtgtggtaagagtgttttcaacacttcctcatgttgatcttttatattgtatgcttgttttcacttcagtcacgtctgctctttatccatttcctttcttctactttcttttgtttaaattgactgattttaaaaaatgatttcttgaagtggttagtagattctcaaattttgtcgtaatgtatttacacaatagggttccccttaagtactgtttttgctgttttagatgaaatcattttattatcattcagttaagagcagtttctaatttctaccagggattttctagccatcttttcattattgatttttggcttcattgcattgtgaggaaagaacacgctttgaatgatttcagtgcttgaaatgtgttgagatgtgtttgatttcataacatctggcatatttttatacgtgtttgctatgtgcttgaaaataaagtatatcctctatttgttgagtgcaatgttctatatgtttatttggccaattttgctgtttatgttcttcagattttctgcattctcactgatttcttttgtctttttttgttttatatgtttctgagagagatatgttaaaattccataatatgactgtagacttgtctttttctcaattacaaaggatcttccatatacctagtaagactttctgccttacagtctatcttatctgatattaataaaaccacaccagctttctttcagttagtatttgcctggtgtgtttgtgtgtgtgtgtgtgtgtgtgtgtgtgtgtgcctatttgaatacttttagctcctgcatttctatagcattatttttagatgtgtctcttgtatacagcatatggttgagttggacagaatttgtcttttaattgcagcattgagttttcctacttttaatgtaataatacacgggtgggttgaaatttattattttattaatttgctatctttcttttagtcctgcttgttccttgttccagtttctcctctttttctcccttctgttgaattgaggatttgttgttgttgcttttaaccattccactttttatttgtctattaccttggaagttgtatattcttttattattattttggtgcttacactagagattatagtatgcatcttgactcaggtcttagaccactttaatggcatttatcactctcttgacttctgtgtcattgttatgtattttacttctatacctttcagatgcccaagacattattattattattgctttattcagtcataattcattttgattaatcatatatttattcttttctttgttcttcattttattttcttgtattatttatctttcatctgggagcactctctttttgcctgaagaacatcattcactatttcctttattgtaggtctgttggtaacaaattcttttgttttttgtttgaagtgctttattttactatcactcttagggatatttcctctgggcataaaattctaggctatctgttatgttctttcaatacttaaaagatattttatttacttctggctttctttatttctgttgataagttagataaaaatccaatttttgtttctttttcacccttatgctgatttttagtttttttttttttttctttgtggttttagcagttttattgtaattggcctgggtgaagttttctttttacatttcctgcttggggtttctaggattctttgtcttggctccttctgaggcctgatatctttcttcagttttggaaagttctcaggcatcattcatcttgtcaaatattgcttttccccattcagtctcttcttttccatttccatgggctatagttacatatgtgttatacctcctcactgtatcctgtagtgtcttatcctgtattttccatccttttgtctttctatactttattctagttattttcttctggcttctaattcctgcttctgctgtgtctgttcttcctttattaagttattaattttagttaatgtatttttaggcctaaaattttcattcgactctctctgtttctgagtttctcatttttatgagttccataggatggcgtagcaaattactagagactgggtagcctagacaacagaaatgtattctctcactgttcaggaggctggaggtcaaggtatcagcagccacactccctccaaaggctctagggaagaatccaccccttgcctcttttagtttctagtggctgttggccttcctttgcttgtagctatctctctgtccctccatttcacatggccttctcctctctgtgtctgtcttaaaatttcttctgccaatctcttataagaatacatgtgattgcattcagggttcatcttgataatttaaggtaagtcctcctctcagcacccttaattcagtcacatctttttccatataatgtattatttgctcctttgctacataaggtaatattcacaagtctcagagattaaaatgtggacatatcttttttggggccaccttttagcctgctataccattgtacgttgaaattctcaactttataattttctctttctataaataggaagactttttacaaaaagtctgtttcagataattctagtatctggaggcttgtgggtgggtttctatttctgttatttctgctggttttgtttatgtcttcttatctccttatgtgcttggttatttttaattgtgtgtgagacagtatattcgtacaattttttacagatataatttgaggtcaagattgaggtttctcaaccccagaagggatttacatttgcttctgcaagcacttggggcattagaattctggaagcatctgattttagtttcagatattgagatggcttgaagatgatccatagacctctgcaagggcctcttagttctctattctcccttcctgctaggacacagctctttgaggagcccagtccaaaacaaatgatacacctggtcagttcccccatccttagcaggacttaaacacaaatctttatttccttggctcctcaatatgtcgttaggggagaaataggcccagaatgccagcttcttttgtccagacttcttccttcccttgatcctggcctgacgcttttttttttttttttagatttgaggtgttttaaagcatttaataaatgctttttctctcttttacttatcttcaatgggaaggtgtattagtctgttttcacactactgataaagacatacctgagactgggcaatttacaaaagaaaaaggtttattggacttacagttccacagggctggggaggccttacaatcgtggtggaaggtgaaaggcatgcctcacctgcggcagacaagagaagagagcttgggcaggcaaagtcccctttttaaaaccatcagatcttgtgagacttattcactatcatgaaaacaacacgggaaagacctacctccatgattcagttacctcccactgggtccctcccacaacacgtgggaattcaagatgagatttggtggggaaacagccaaatcatatcaaaagttttatctggcatatctagtgagtcattatcagaagcagtagtctctctgaagcttttctcatctatccaccttacatttttatgattaaaaattccaaaaattacagaagtggagggaatagtccaaatattcccccatcactcaaatgcaactcttatcaagattttgtcacaatttgcatggaaatattcacaacctataagaagagaaagttttaaagcaaggcaatatctcaactcacagccatccacttacctctaatggccagcatcagagacaaagacttctgccttggttactgctgtcctgagcttctagcacaggtgtgcccctagatgatttcagtgagctattgttaaatgaatgtgaattcactgaagaaccacagactgtgggagctggaggaagtcttggcttgtcgtaatgaaccacagattacagatggagatgctgacatcctgagattaggtcacagaggtgcatgggagagttaggccaaggtctcaactcagggctctctccacttttccacacttcctcctcattttgctagctcatttaattaccactttttcttcctttctgataacactgaagtttaagagcatttcattacaagtgtgatgatacaatgtggtattaagacatgacaaggcaagttttattggccattactatttgcctcaagtgagtggcaaagcctttgaccactcgaggcatatattaatagccctataaaatacatcctggattgctagtgctattaccgtctggctattacatttaaaaaaatattgtacaaataccacttcaaataattttcttactcttttttttaaactggaacgattagctttttttatgagagacaattcttcacatgatggagaaaatagaattgtcaggtaacatggaaagagtataagctttggagtcgtaccaaactgtgtgcaggtatttgctctgctatttatcatcactgtgacattaggcacttttcttaaactctctgggtctattttcttctctgtcaaatgacaacaagaatgcttgtcttttagaattcatatgtatatgaaaacacctggcatagggccttgaacataatgagtggtcaataaatcttatatttttgttgttgttattattgtcatgataatgaaatccaatgggaaattttttcttttaattagttgatttatttgtaagactaaaaatgttgttgttataacagatccttgtcttgcagggcagtctttctttgtttcctctctagccctcatcccttggaaaaatgagctgaaccatgttggttggtgcaagaggggctgacagaagagagttttgataaatccacaagataactttggaaactctttgccattttccctcctactcaatgctgctgggactttgagctcgctgaggcagtctaaggctgtgctttgacttcagtgctgtgccttgtgcttgggataattgtgttttccatttgatggcccccaatgctttgtgtaggaattggatggtgcacccatgctcctcaaatgctgaagcagtcatgtcacttggtggggtgaggtggatcatcagcaacaacatacttttcttttctttttgaattaagcacacggaaaaatccataatctaaacatgagggacattaagttttggatggaagagagtgaattttgcaacaataacaactaaaaacccaggacacagaacaattattgaaaacaacttgctgaagtatataaataaataaaagtgtcatttctgaagtatctttccttccctaggctcactgccattgtcatgggaaaagtgtgcatggcagcatttactctgaggtaataacatggatacatttcccgttgctcaagacttgtacatagagtctgaagacaaattcttcctatcttgctgagaaattaacttctatttttccattcctgtgagccagaagggtaattaccacatgctgttcagtcatgagtttatggaaagaaacacaggcttcattcagggtcttcaccaactgggtggggttgggttggtcatggagagaacttacattgtgggtttacagctgtactgcaaacatttcttcaagtctggagcaaactcagcccctctttcctgactaacttcttccctgcctaatccaatgaagacaatggttgatgagaataatagcagttattgcatattaagtattaatcagacatgttattctttaaacacacttttgctttttttttttttttttataataatcaggcatccaatgagatctgtcctctttttatcctcatttcactgagaaggaatggtggctctgaagagttaaataacttgcctaagctcacaattttagaaggtatggccaagactcaaacccagattggtctgattgtcaaagttgtgttctattcttaaccaattttctactttctttggtaccatgattatctccttgccttataaatattcttgtatgtggtattatctttgtcttattattcatagtacacaggggctttttttcttcctacttgcatttccagttccttccttattaatcagtgtgagctttttgcgattgagccctcttttctcttgccccacccgccagcccacctcctgttcaaatacagccctgcgggtgaacactatgggcgacccatgtgtgtgggctcataggaagatgcaatgtggagaagaatggaagcttctatggcagatctacattcttttttctgtcctctccctctctctacacccaatgtactttattttttggcccatttttgctcctatatgccctttcatcatcctcagaacctgtacccttggcattttgtcggtagacatttatatttcctggcattgaggctatagatctctaatacttgaattgattttcaaaattagggaaaagagctgcgattttagctatatatttgggctgtttgagttgaaaatgatgaagagtaaagtaatgtttgctgtaagaggtgggaggcaggactgtgacacggtcagctgactcttagatgtgtaataatggtctggcaccaccagtctctcactgtcttcttgaaatcacctctaaagaagagtttgatctggaaggtcaagcctagcagtgaactgaagctgttctctctgagtgcatttattcatttattcacaaagcagttactggtctatgtgcctcaagattcctaaatctcattgagccaccaacccttttattgaaagctacaggctctttttttcacaaaaattcacagaatacataacatggttttgcatgcaatttgaagggattcacagatcctttgaagcccatctgaggactgccagccaggacccctagcttggtgcactacctttcttgtttaatcacattctaatctccaaatcaaggcctcttccattgtgaatagagatagaaactcagctcagattctttgatggaactgtgttcagccaagttgtgtttgctcatcactgaagctttaagagatggttaaagaaacaaggtaactgtgtggaattacttatgatcacaaaggcatctgtagcaaaggatcagtctttacaggagttgtcttctgagcctgggtatgaagggtctctaaactattttatgggaaatttaaatccctcgatcgaaacaaattatcataggagggaagaaaaagtaaatctcattaatggttaggtgtagtgggttaagtatttgcaaaagtcttggtcattttgaaaatggtaataccagtgcaatgagttctgaaatctgtagacatagtgtgtgtgtgtgtgtgtgtgtgtgtgtgtgtgtgtgtttctgaagaaaataaaaattttcacatctaaaataaaggctcagtttcctttggggtgccttagttcacagcagtatgacagctaaccagaaagctgccatactgtgattctgtttttatattatttaattagatgatttaaagattctctaaaaattctggtgcagcctttgtgttcctgggaggaatcttacataacttggagtcctagaatagaggaagagaacagtggtacccaggcctcgtttgctgttatggtttatgtcgcagacttgctaggtatgacttccaacaacacaaacagaaggtgacaggttacaaaagagtagataaaattttttgctgacttttctcctggctacactctccctacttcctccccattaagagtaatgggagagttcctgaactaaagttgcattgtgtttccatgcagaaaaccaaagactccccgtaagctgagctgaggtaggcagggcatgaaaccgaagggctgcaggtttgtcatttgttgttaagagctgtggcatatttggccaaaggggctcattgtctacagccttctgtaagttattctgcaatattccattcaaaggaaaagcagccaagttctgtttccacctttctaaaggctttggtggttcctgtccattgggtgtgtgtcctgccctttgcctcactgtctcaataaagcatgtgaagaccagcttcctctccggtctggcggatctgttctcaggctgagcagagagtggcaaaggctgcatctgcgttgcttgctcctggcattgcctgcctgccagggcaccacacaagagctcgggcttacaggcacactttgggtgaagtcattcttccctgaaaactgagatgggaaatttatcctgacatgtcagaactgatgaagaaggctaagcaatggctacctgagcattagtcttgggagtgtgttctttcaagcacaggtttaggtttgcccttctattgtttcttctactaacacattatgaaggtagatttccactggaaaaaaaagaccagaatttgaaaatgtaatagagtgcatattcattattaagattataagaaagcctttgagaggatcaggcagtgagctgagaattatcactgaagtttaatttgtttattggatatctggatggaaaccagcaggactggccatgccctgttcctctttcacagccctgcttctgcccaaagggctcattcaaattctttttcattctttcagccctccacatatgcggagaactctcatattttccacattcctttcttctttggaatcctgctctaaggaaagaaataggtcttggtcacctataccttttacaccttactgtgaatgtcaggatagtgtataacctggatattgatactcctggggcatttgagtgttatcgtttactgtgagttagaagactttgacttctttaaaaaggaagtagaagccatgcttaaatgctttcaaaaacaaacctgcacagtttgtgctttgccctatttttgaatcatttgtattaatgctgtgacattgtgagcacagtgtgtgtgagtcttgggagaagtgaggacctgcaaagttctggcttgccactaacctgcactgtggctttgggagtgtcagctccctgcatcactataaaatgagtaggttgtattaggtgatcaccagaggccctgctagacctgacagtccaaggataaagttgagtgctaaaggagcaggctgtgtagacagattgcaagtgtccaccagtggatggtcttggcacaacaaggctgcctcctcatggtctttggtcccaacaagttcaatataaaatggaggaaatgttataattttaagcactgataccagggtttccttagggggagaattgcctttgtgtgggaaaataccgtgataagacatttggagtagattgtgaaacactgaagacattagtgtctgggaacctaagccaaaaaagagatgattaatcttttgtacacaagaaagtaaaaggaatttgtgctttgttcagccttatgcagaggtagaaaagaaaatagaggagaagagacaagagaggaaagagagagaaaatctggaaagatggcagaagactggatgctgtgtgtcctaaaagccttagtaagaaaggcttagagatattaggaactgtaatgtctaatgtgagatattaatttagtttactgtgtgttttgctctctagtttctgtgacttaccaatctctaataactcaaaaatggtttttgagtgaattattttgtgaagactagggaaggcaatgaggatttttttttgcctagattaattggaaacagcttgtatggaaataaaatattacaggcagaggtgactagaaaacatagccccacccagaaaactgtagacgtcttagtgagaggtttgcatctccactggacatgcagtttggaggtctctagccaatgtcgtctagatcttccagggctggtcaggtgggaggttcccaaatgacatttttttttttcataataaaataattttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatctgatttctcaatcttttccccacctttcccccctttctattccacaaaaccgccgttgtcatcatggccccttctcaatgagctgttgagtacacctcccagacggggtggtggccgggcagaggggctcctcacttcccagtaggggcggccgggcagaggcgcccctcacctcccggatggggaggctggccgggctgggggctgacccccccacctccctcccggacggggcggctggccgggcggggggctgacactcccacctccctcccggacagggcggctggccgggcagaggggctcctctcttcccagtaggggcggccgggcagaggcgcccctcacctcccggacggggcggctggccgggcggggggctgacccccccacctccttcctggacagggcggctggccgggcagaggggctcctcacttcccagtaggggcggccgggcagaggcgcccctcacctcccggacggggcggctggccgggcggggggctgacccccccacctccttcccggactgggcggctggccgggcggggggctaaccccccgacctcccttccggacggggcggctggccgggcggggggctaacctccccacctcccttccagatggggcggctggccgggcggggtattgacccccacctccctcccggacggggtggctgccgggcggagacgctcctcacttcccagacggtgtggctgccgcgcggaggggctcctcacttctcagacggggcggttgctgggcggaggggctcctcacttctcagatggggcggttgccaggcagagggtctcctcacttctcagacggggcggccgggcagagacgctcctcacatcccagacggggcggcagggcagaggcgctccccacatctcagacgatgggcggccgggcagagatgctcctcacttcctagatgggttggtggcggggcagagacgctcctcactttccagactgggcagccaggcagagaggctcctcacatcccagacgatgggcggccaggcagagatgctcctcacttcccagacggggtggcggccgggcagaggctgcaatctcggcactttggggggccaaggcaggcagctgggaggtagaggttgtagcgagccgagatcacgccactgcactccagcctgggcaccattgagcactgagtgaacacaactccgtctgccatcccggcacctcgggaggccgaggctggcggatcactcgcggttaggagctggagaccagcccggccaacacagcgaaaccccgtctccaccaaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttccgctcggcatcagagggagaccgtggggagacgggagagggagggggagggggagggggagggggaggccaaatggcattgttatggggtcttatctgcaaacgcagaactccattatgttttaatgatggatgagccatttttacaaatttgcaagattctagaagaaagaacaatctggaatgtgttcttacatacttttttttggtttattttgtttttctgtttttttttttccaagatggacactcagtgtgaatgttcttatgtactgttgattgtacctctaagatgatgtaatgacctcatctcatctagctgtcaacaatggcccccttttggccagaggttatttgactgcttcagagagatctggaaaacacaatttcttagttttatctgtggccaattgtacctctgtaatggctgttttgtccaccattgttttctgggatttctgaggaaaattctgagacaagtaactcctttgtttgtggaagttagttttggaaattacaaatgaagtatctttttttttttgagatggagtttcgctcttgtcacccagctggagtgcaatggcatgatcttggctcactgcaaccccacctcccgggttcaagcaattctcctgcctcaacctcctgagtagctgggattacaggcgcctgccaccacgcccggctaattttttttttttttttttttttggtatttttagtagagacggagtctcgccatgttggccaggctggtcttgaactgctgacttcaggtgatccacccgcctcggcctcccaacgtgctgggattacagacatgagtcactgtgctcagccagacaaatgaaatttctatcctaaaacagcatgcattacctaatcccaggtggttaaaaaaatgtatatatatttaatggttgctctgaaaaaatatagacagcatgggttccaaaatattaactatagtaaggagtcccatcatggttttcatagcatcctatcctgtacttgtacttgtatgttgttgcatttataaagattgaaattcattactaatgtagttggttatcagtttctttcctagaacagggagcacctgtcctgaaccaggtccagggtagtgtacatgacacctcagcaatagagtgattttctctagttttacagtttctacagtgaacatattatttttcctaattacaaaatataaatctctttaaaatgacgcatgcataattaggtactcagtattacttttaggaaattatatttgtgcaactgaagaaaagacctacatgggaagaactagaatggaaaggaacaggttgagggatgtatataaatggtaggtttctcactttgggaggccaaggtgagcgaatcatttgaggtcaggagttcgagaccagcctggccaacgtggtgaaaccccatctgtactaaaaatacagaaattagccaggcatggtggcttatgccagcacatgcctgtgatcacagctacttgggaggctgaggcgggagaatcgcttgaaccggggaggcagaggttgcagtgagctgagattgcaccaccaaactccagcctgggcaaagagtgagaccttgtctcaaaaaaaaaaaaaaaaagaaaaagaaaaaaaaggtaggtttctgctcttggatctaagtgctcgattgtagagaagatatcataaagagagtccaaagtgtgagttcatacccacaatagccagtaattgacatggcagctttgttttgccttcacttaaaatactggcatggtgtgtattttgttgtctgtccttcagaattggattttgttttttcaaggagaaaaatagatgagactgctactataggatcccttgttagatatattacatttcaggatatatttccaggcacttcgtggtggaaatctggctctcggagcttaggcttggttttgggatattttctgcatgtcagtatatttcagtatgcctctaagtaaaccaagtagctcctcctccccctcaacacctggtatgattcatgactgatttgggtagctgtaatttttctaatgtcagttagaagggaaagaatttaaatttactacatgccaatcatattccaaagccatacttagtattaaaaccacagaaggagtcatttacatttaacaggagctgtgggtcttaagcaatgatcatttggtaatgtatgttttgattttaggttaaaaagaaccttgatattgtgggatttctggttttcagatgagtggctagtagcctgtttttagaaagacattggggatgggaacatgtatttggcttctttgagtacagaaattctgcttcttggtggaccacagtttgactttgttttcggggttaccttggtgtaacaaagcatcccttatgccttcagggctgtccttaccacccatcacctgccaattggttcctgtctatgtcagtgttttgaatcagaatatgaggtgtgaaaaatacttcattcgattttagaccactcctaccttttgggtagtattacatttgaaagtttaggatttggccttgttcacttgtttatatttttactctaaaataggtgttaaatatattttgagcatttactgttgcagggcactgtactaggtactatggaattacatacaaactggagagataggctctgctctcattaagcttgttgtatgataggaaagaaggaaaacaacaatgaaaaagctacatagccctttcattgcagagtggtcagtgctatggtgtggacagagtgtcctgagggagtctaagtggaagataagttgagggagaagtggatagagagtgtgtgtgaccttatgcaaaggcactggagtaaaaaggtgcatctgtcattgaagagaatgaaaaaaaaagttcagggacaggagctcagtgagggaaggtgagtatgcccagaccatgaagtctcctgggctacagtgaggactttggactctatgagctaggagtgttctgcccacttaaaaaaagacatgtaggggacacacattattttatttgcctgaagcttgaccacctctcctttagctcccttccgcattctggaaaatgcttctccatttctgtagctccatggttaccatggaggcagccacgttgttttaagctactctgtgtcccaaccacagatgattgatccagggattttatttgattccttgggggtgttggaattggattataaagtgaagagctgttggagaccaagttctgtcaagcagcctaaagagcagagatggaagaatgaagcaagaccacagagagtatttaaagtaaaatctggctgggtgcggtggctcacacctgtaatcccagaactttgggaggccaaggtgggaggattacatgagaccaggaattccagaccagccttgccaacatggcaaaaccccgtctatactaaaaaatacaaaaattagccgggcctggtggcatgtgcctgtaatcccagctactcaggaggctgaggcagaattgcttgaacctgggaagtggaggttgcagtgagccaagatcttgccactgcactccagcctgggtggcaaagtgagactctgtctaaaaaaataaatgaataaaaataaaataaagtaaaatcaagcagagataggatattcctgggctctccacatgctccaggcactggttccagacctttccaacatgaatcctagtcttgggttctataatataacagtattcccctaaaaagttttctgtccccactttctgtttatactagccacaattagtttctgtcactaatgtaaaattattttctctatatgtgcaggtatttgtagatatttataataattttgctttagggcaatcttcggattgtaaatgggccttaaagcttcttaattcatggaaagtcaattatcctctagtttagtttgaggatacaaagggacaggagaagttaagctcatctcatatttcccaagaatgtaaatgtgatgaaagggaactttgcagtctaagcaaaaacacttggacaagataacttacggacttgagtgtaaaaacttaagaagtgaactttcacttgtagcagttctctctgatgtgagtcttgctagtccactcaggttttatttcttttagaaggtgatgcaaacagcaatattattagcttaaacctaaaatgtggtttatttaatgtaaccatgaccaactgcattttcataattctgtctttgctgcattatcagctggcagggttattcacgctggactagctctgagcctgctaattcaaataaacagtccttgccaaccactgctgagctttgagaaggtctaggctaaagatgggcaaattaaagacaattccacactgtggtaagataatcaactactctgattacctagtaactaagctaattgggaagcagtgtagtatatgggataagagcaggctgtgtggattcagacctgtgtgggaattccacctctgctgtctacatgctagatgacttcaagcaagttccctggtctttctgaatctcagttttcctgttgataaaatgaggtaataatagtacctacttcgtgggactattatgatttagtaaaataatatttataagacacagtaagttcttttttttattattactttaagttctgggatacatgtgcagaatgtgcaggtttattacataggtatacatgtgccatggtggtttgttgcacctgtcagcccatcatctaggttttaagccctgcatgcgttagttatttgtcctaatgctctccctccccttgcccccgactccctgacgggccccggtgtgtgatgttcccctccctgtgcccatgtgttctcattgtccaaatcccccttatgaatgagaacatgcggtgttgggttttctgttccaagacacagtaagttcttaagtattagcattattatggatattattttgtaaagcagttaccataatgcctagaatttgataaatgctatttgctcttttaccttaaaaatgtacctatccatatctttgaaacttcagtaagtaaatgtcttccctgatttacctgcctttgggcagcaggttaagaatccctgacataaactgaccttctcattttatagacagaaattgcaaccccaaagagtagcaatttttcagggttgggcagagctggtctggagcttaggggtctgtctcctaattcagtgctttacccactacactgcctatttcaagtgcagatgacctagggcattctttggctgcatcaatatgtataaagagacacatgatgcttgcaaaaggtacagttagagacttttacaaacccccaaacttgtggatatggaaatgcttatatactccttatttttccccaaatcatatttctataaggattctcatttcctgtgcacattccttttttatgtgaatacagttttcctgaagtatcttcccttgcttgatggcaattttttctttttgaggtggagtctcactctgtcgcccaggccggagtgcagtggtacgatcttggctcactgcaacctctgtctcccgggttcaagcaattctcttgcctcagcctcctgagtagctgggattacaggcgtgcgccaccatgcccagctaatttttgtatttttagtagagacggggtttcaccatgttggtcaggctggtctcgatctcctgaccttgtgatccacccaccacgacctcccaaagtgctgggattaccagcgtgagccactgcacctggccgatggcaagtttttacaaggaacctgagtttgtagtcacttcacaggcattacaaggacaagggaggaatctccaagttttattgccagaaagatgctgggcccttgggacctacatagctattctaaacactggatacatcaaccacagaatccaagtttgcatctcagtgaaatttcacactagaacatattctttggaattcctcgtgaataattgaaacaatgattgttaagtcctttaatgctaaatatttactctataatggtcccattctactggacattggtcagactgccatgttccattgagggtcgtatttaagagagctgtggccaaacctaagttcacataacagcatgcagtgaggatggaaaggagttctaggagttgagttatgtgagggatggtgtatttggcctgcatgggagatgaagaggagtaataaaaggcaccatcaaatattttaagtctgtcaggggaggagggattttatttactctatcatactggatatttcagagaggcatattttaggctgtttattttaaaaagttaggtgaaacttgaacaacaatagtaactataacaattaagtcttccagttattgagcatttagtgagtacagagtcctatgctaggtgccctccagggattgtaatccctgttttatagatgatgataatagatatatgtaatagatagatgtaatccctgttttataggtttgggaattggtccttaactggcaggtccgtgggactgtaaagcctcaggaagagcaattgcctccatcacagaaagcataagaggttgtaggaagaatagattctgtgggcacaggcctgccttgtattccactctacccggagtgcccagcactgggcctggcctctgccagtggtcagcaaatggatgtgcaatggacacatgaacagactctgcatttggtgggagctttgaattctctgactggacttgaaggaccttccaaagtcactgaccatttagatggaaataaaatatacatccccatcacttggctgttaaatataagctcgtcacagttaaagtctggcaaggctggactgggggaacagtggcagttcctgagagtgctgagggtgggattttccttacagttctattaattggatgtgtccagagtgatctcgtgtttccttgagaattgtggccacatactgccctaagtgctgctctctgcattttgtggcagttgatgggatatgatgagtttgtggggacaaaagactttaaaaggtctctgtgagaaatgactcctattgcctttgggtgagaggccaatttatcagaatagcaaatgccttatgttagtggcatactttgaacacttgccatagaatgtctcctttgatccttgatagataaagaagatataacccccattttgcagaagacactgaagctcagagaaattataggaattgctcaaggtcacatgaaattccaatctttctctgagctccagggtcagttatcacctgcctacttgataactccacttggatagctaatgggcacctcaaatccagcacgacctaaacagaggtcccaactcctgctctttctctgaagagcactgatgctctctgtttcagtaaatggcatcccagggaacccaggtacattagtcctattgctgctgcaacaaattaccaccgacataaaagctgtacaaatttatgatttcacacttctggaggccagaaatctaatgtgggtcagctgggctgcaatgcttctggagtcttcagaggaaactgttgtcttgccttttccagctcctagaggcttctgatattccttggcaagtggcttgcattactctgacctctgctttcatcatcacatctccttctctgactctggccctcctttctgactctgcttccagctttcccttatagggatccctggaattacaatgaggttcacctagatattccaggacaatccccccatctcaagatctttaatttcatcacatctgcaaagtccctttggcatggaaagtaacatattcacaggttttggagattaggatgttggcattttgtgggccaatcttctgcttactacaagggatcacccgttgttctttcatccagtccatcagcaagccctgctgggatctccaccaccaccaccttacctgccaccctcactcacctgggctatttaagccaaaacatcccatctcatctccctgcttccagccttgcctccccactgtctgttctctgtatagcagcacattaaaaatgtgggtcaggccaggcatggtggctcacgcctgtaatcccagcactttgggaggctgaggcgggcagatcatgagatcaggagatcaagaccatcctggctaacacggtgaaaccccatctctactaaaaatacaaaaaattagctgggcatggtgatgggtgcctgtaatcccagctactctggaggctgtggcaggagaatggcatgaacctgggaggcggagctagcagtgagccgagattgcgccactgtactccagcctgggcaacagagccagactccatctcaaaaaacaaaaaaaatgtgggtcagatcacaccactgccctgcacacaaaccctccaggaggtttatatcatactcagaaaaaatgtacctgtattccttctaatagttctgggccttactgtctgcccttattggccttacatttctgagctcctctcttccactctccgcctcactcacgctgttccagccctcttgccgtttaaccatacctggaacatgcctggaatgttcttcccttagacatctgcatggctccctccctcccttctttcatgtctctgcctaaatttagctctgcagggctgtcttccatgtcaccctgcctgacctgacactgttttattttcccatccaagcacttggcacgactgaccatgtattgtgtatatagtgcttgtaagtgtatcatctacctttctccctcagagggtagttccatgagggcagataatttgcattttctcagaaactggaatgattacttgcgcatagtaagagctcaatgagtatgtagaggaaacctgaagtttaaatctaggtcttctggttctgggtagaatgtgctcttctctcccccatgcgttatcttcataggtggttaaagaaaagtatgattttgtaatatcagcgaagtgtttgttttcctaacaccttccaaaatatcagtcagcacaggtcaaacatgcccctatgtctgctcagaggcaggcaggtgaacaagtgaacagctctctctctctcaagccaatgaagagccgtccactctctggcaaagcactgagctatttgctgagagtttcccaaggtgaaccgaagactccttgaaagcctccttcactggctatgcaccacttgtaattatgtgcacacattttgtaaccctttcatgagaggtgggatcgtgcatatagtgtttgcatatcccagaattgctccctgaccagcacagctttttgggtaagtttaatatgggggtgattatgcttgagaatgttcactggaccacaaggcacctcccatattctggagatgtgtgtgagctgcaaaaggggtacgtgagctccaggaacaggtagcatcatttccatcagctcagccagactctgttgtgcatatgcggcatgctgaggattgagacgagagctacagacacaaagctcaaacagctccagttgttgctctggaggagcttgtagtctgcgtcagtgctacttagagtggggtctgtggaccagcagtatcagcatcacctggacatttattagaaatgcagaatctcaggactcaccccagatctcttgaatccagatctgcattttaacaagatgtccagtgattcctctgcacattaatgtttaagaagttttgctggctgggcacggtggctcatgcctgtaatcccagcactttggaaggccgaggcaggtggatcacctgaggtcaggagttcgagaccagcctggccaacagggtgaaaccccgtctctactaaaaatacaaaaattagctgggcatggtggcagacgcctgtaatcccatctaccagctactcgggaggctgagacagcagaattgcttggacccgggaggcagaggttgcactgagccgagattatgccattgcactccagcctgggtgacagagcgaggctccatctcaaaaaaaaaaaaaaaaaagctttgctatagggaaagtgacaaacacataagcagataattactgtgcacaatgagattgtgttaagaatgggaagagtaggaagcacagctgcccagagaggagcgtccactctaagtgagtgtgtgagtgcattttttgtgtgtggccagtaagggggtaggtatagtgcttggtcaggaatagctggcagaatgaggtcatagctgaggtaatgtttgaaggaaggagtaaatattttaataatagtaatcatagctttcacctatcgaatactgaataatagtgtaacaaataatagtaaacacaagtagttcttagcatgctccaggcccaggcctactcattttaattttttttttttttttttttttttgagacagggtctcactctgtcacccaggctggagtgcatgatctcggctcactgcaacctccacctcccaggttcaagcagttctcatgactcagcctcccaaatagctgggattacaagcacataccatgacgcctggctaatttttgtattttttggtagtgataggttttcaccatgctggccaggctggtctccaactcttgacctcaagtgatccacccacctcagcttcccaaagtgttgggattacaggcatgagccaccatgcccggcctcattttaatttggaatgcatttgttttaaaacattaactcattttaatctttacatgtctaaaaatgaaaagaaaagaaaaggggcacgcagaatttagtggaactcccgactacgattgctggagtgccaggtgagccccagctgggcaattcaattcatctcgtgcctgcccttcctctttggggagactgccttgctgctgatgaaatggaggtagagagctgtgaagctgagtcccgttagcatccccgtgatgaacaaatcatgcgcattctttcaaggtgatgtgaagagatgactaaaaggttttgaaaagttccagatagaaatcttcttagatggcattgactgggctggggaggggcctgtttctgtgggtgagttgcagtcctccctacctgaccttgcgcaatgtagtctgtccctggttggggatgtgccgcactccaccgactgcatattaaaaagctgtattgacttattcctaacagggaactggctctgatttccatttcacagcagctgtcatctgctctactcttcagcaacaaacacggggtcagcctggccccaacttttttccctcttgtgatagtgttaaaaagctccctaactgtcccagtctttctttatgtggatttgatattctgtctgctacctaggcctttcagagacctccttttgatcatctatttcttcaggggtttttattgttgaaataaaacttgggggtaaaatatttgtatacaactattaatcttcattgtccaatatggtagctactagctgtatgtggctctattgagaacttgaaatgtggagcatctgaaccagatgtgctacaagagtaagatacacaccagattacaaaagacttgattaaaaaatgcaaaatatcccattactaacaagaaggtaaaatagctcattaataatttttatattaactagtgaatattttggatctattgggttaagaaaatatatcaaatttaatttcacttgtttctctttactttttgttaatgtaactactagaaaatttaaagtttcctatgtggcatgtgtttgtagcttgcattacatgtctctggggcagcctctctctaaacccatttgaccaggagcagccaacaaggtttccatctgctggaatccatatttagagtcaaaggtcagtcagtttaattccacacatgggatttttccctcaccccctcctccttacctgttccctggacctccttatcggatcttgttcaggttttgggcactgcacctattgattgatccctcagtggctgctggttggctctttgtcccaccttcaccatcatctggtctttctgggactcctcagcaggctcctctgggtgggctagccctaaatgtgagtgatcctcacagttctgacccctcctccacctctctcccctctgctcctcttccctggtttgggactcagattcacattgaaccttttttaactggcagggcaagcctctgtggtccatctggaaagaaccacaaagcatcctttgtcatcctgttttagtatctagaatacactctgaagatcagaagcagtctctctgtacaagacatgtgtttcccatcagcagacagcagactcttttgtagctgggttcaaaatctttgttgttgaccgcttctggcatcttagcttttgtgaatctggggtgataccttttggtttccctgccttttctttaacaccagatctccttcatcctgatgcatttttaaacaccagtcaggatatgccatttatgttcatgctaaagtcttcactgacactcaccacaccaatctacttttattcccagttactatgttagaatcctatttagatagatggagccaattgagcgggccctgcagaaagccatattcagttagtgtaaatcttcctgctggtgttggagacagcaaggtcccctgggattctgtctggaaatcttattggattttcaagacttaagttaatatagagaccccccaagatagtatagggcctcatttctttgccttgaaagatgtttttagaggtctgtctcaagagtctcgctgataaggaagttacttcaaatatttcaagagaaacaaccacaaagagtcttctattttctcaatattttttctctccctgcccgtccatctttttagtattttttaaatgcctgccctctatatttatttccctctttctctcatgcactcattaaccttaggcccctgtttcaaatggaattaattagtaaccataaaacttggtaagtgatggccttaagggaaaagtctttctttcttctttctttctttcttttccctccctccctccctcctgcctttccttccttccttccttccttccttcctctctctctgtctcgctctctttcatgacgaatgaatataccttgtagacataagtgaatacatttcatgatactgtacttttttcttttcttaatcaagtgaacatcttccttagtgacatatagggtactgtctcctgacttttgctctgagacgcagcactcagcagaacagagtgtgggctttggattcagagccataagtttgagtcccagctctccctttatgctgggcaaacagtgtcgctcttctgcagttccattcccatgttagtaatataggcacgaccatttctgccttgccatattgtgttcagaactaaaggtgattgtgcatgtaaagtgcctcactcccagtgggctttcaggcatccccaggtgctgcgttttattcagttaaaaaagtcaaaggaagagtctaaacacctcccaccagggtcgttgataaatatcttgtctcagccttcttgagtccagcaaggatgtgaatgtcataccttcagtaaactagattttgtacttctagaagacttttattaggcacataagaaaatgatgctaacaaagttcaaagttgctccgtgttgcagtgatcttttaaaagggaagttttgaggtagttttgaagcagatttctggaatcatcttcaggactttcgtgagctcattgtaatgtgttatgtgaaatgcatgtcctcaaaacatgggtggttgtataaatgaggaagctggcctcatggagccaaagcagcatggaaaggcccaaataacttgctgtggggaagactgactgcctctggggtttttaatcagcatgaaaagccacccagggccccaaatcattagtagcattttaattggcagcagagtaatactgtgtctactttggcttaaagatataaatttcctgctctctcataacagatggtgatgaggtgcatggtaggaagcatggcaagaactgtgttactcaaaatgtagacttaattgcaaatttgaaatggaaataaagtgaaggttctgtctttatttacaataaatttcatgtgttaaatggacttgtctaattcttctattttaccatgcgattgaataataaacatttattatgtgcttctggcatgcactgtgttaaatattttacatggattatgtcatggatctcttgccatgatcctgaggaaagtattattgctgcttttagtagcatcgaatgttggaataaagtctgcaggggcagctggtaatatgtcagcaatgtctgtcttctgagatgagacagtgataaaagggctgactgcccacctagggaggcagtctcatctctcattagtgccaggagccatagaatgtgagcctggaggctctcaccaccaggtaggtgaccctgtgcacaccctcccattgctctcatcacattagaatagcatctgcagtctttactctcacctttaaggccctgcatgacccagcttcatcttctgctattctccctatgttctttttccttcctctgcttgatgttcctatgtagcagttattcctacctgagattatgttatgtgtcaaacaggaagatcaggctgccaatcccaggtggggattatcaacctgtggaggatggcaaagagtataacaccaccaatcacgagaagtcggagcccattgaccttggcccctgcattgcctatgggcttggaatccccaaggagacctcagcatacaaggtgcttgttggaacaatgctttattcacagaaaggagaaaaggcacagcaagatcagcatctgcagcacgtgccagtctcccatggttagcagaactctccagataaagtggaagactgtacccaggctgctctactgcaggagaacaccccgttccctcctcaaggggagcagatatacaagtggactggccaaatgccatatgatgaatacacttaagcggtagcagaaagttgtgtctccagaacaaggaaaaacttctcccagtgaggaagaagaatctaggagccagtggcaactccagatgagggaagtttcctggtccaggccactgactgggcaatcctggggagggatgacaggctgagcaatggctgcttccccgacagcacatccccagaccttcatcaagatgccaggacaaaaacctcaggcatgtcacacccaacagaacaaacagctcccccaaatatggagtgcttccatagtcaccaccgaagatggaggtgttttcagcatggtcctagaatgagtctcatggctccctgcccaactgagatagcactttgtcagggccagtccaagaaagatgatcaggcctccctggttctcagccctgagccccaggtgctgggatttagtcagttaaaaaagtcaaaggaagagtctagtggatacacaggtttacagacaacagccaccctgtttgaaggtagattgcttttcctgaatacttgatgtacacacagcaagatacgttggcaatagcatggactctgccctggagagtcacccaggccatctgtcctaacccaagggctaccacctctgcaggaacacattgctcttgctgtttccccaaacctctctgccctgatcatccaatcgaggcagtgaggttatggcttgtacaaattttgcgtgtcctataacatcacccacctgtacaggggagttgggagttcctgatgctaccagggggattttggtattgtggtgttttatgaccctctcctttcctgtggggtcccaaggaggtgaacaacctagggcagcataacttccaagttagagtaagggatgggcgtccctgtcaggcactaccactgcagggaccacagaccactccgggcacagtgttccagaaggagaaactaaaggagtggttgggtacacagattgggatgcctcagtcacagcctaatcaggtgactgcctgctcctctacccctgccaaactcaggattctccagtgtggatttcagtgccgtttccctttgtctggagtgcagtgtcaagagtccaaatggccccagtgaggtgagggtatcaccctgttaacaatccttctttacgtcccttctttaactgttgatttagtcttccattccactgttctgtggctctcttagcttatgggtggtgtgaatgtgggaggtgcagcatatgccatgggattgtgtccattgttttgtggcttgtgctatcaaagaagtgccctgatttgattggaattcagtagggtacccaaactcatggcaaagattttttttccagggcaactatggtggtaccagcattcacatgcagcacagagatgacagttctaaaccttaagtaggtgtcagctgctgtgaggcaccagaagaatccatggccgggtgttaaagatccagtgtgatccatctgccaaacgagcctgctgatacccctcacgataggtcatcattctcgtcatactgtttgggctgattggtgggaattgcactgcattcttggcttctgtgtcttctcggattacacccatggatttggcccattcctgcatttgagatgggattccatgactggttcattaaggcacccagcgtgtggcccttccaacttgttttggacaggctctgataccttaggaattccccttgtgttcttatttaagaggcactttgctgggagcatatacatgagtgataaagatttgcctatttcatgcagcaaacttgccatagtccctgttcccacacagatttttaatagttcagtcatgtagttgccagtctcctgacgaaatggctagaccaccacccaggaattggcaaagatgtagcaaggtgtgtggggtagggtggcttgtacaccattaccaccacatgaaattcagccccgtgggctaattgttctcttccagtttcaggtaagaatggctctccatggggtgggtggctgtgggggcacagtggactccatcaactcattttgcagaagcctgggtaaactaggccatgccttcagctagaacctcttcaacatggcccaggtgactagggaagggaccagcactgtgctccctctggcagggtggccacctgctcatgtagttgaccccttggggtcctggcctggctcagtcttagatgtaacatttccatttgatgatggaaccctcctgggcttttccagttttattagtgagattggtgaggacccaagtaaggatgagcacttgaggcctcagaaccacataatgtgctttggtagtgagatgttcagtctccaccagagcccaatagcaagcaagaagctgcctatgaagggtgtgtattgggcagcagcttcaggcagcttgtgtgtccagaatcgcagaggttgcaccccgctcagaggtggttttctgctgctactgactcagcatgttgggtgctgtggacatttgaagtttcatgcaggctccaaatatcccactcagagtcagggcctgggccatggcttgttgaatagttttcactgctcattgctgagaagtgccccatttgaaggttgctgtcttttgtgccaccttgacaagggggccagaaggatacccagatggggtatgtgttgtctccagtgtctgaacagatccaccagctgctgtgcttctattttatcagtgggagagccaggggctgtaacttctatttaaccttctccgtaatactctgttgattttatgctcagatgtccctgagaaactgtacttgttgggtgggtccttgaatcttatctggatttatggcccaactggtgttagtcctcgcattggtgatcgagcgaaaagccaaggccacttgttcttcagtgggatccacaaagaagatgccatctattaaacctgacttgggcttgctgtaaatcaagccctacccattgctgacaaatggcagggtcatgaagggacccctgagggaagacggaaaaagtgtattacaagccattccacaggatgcacattgatcctggtcttcttgcccctgggaaattgagaaaaaggcattggccaagtccgtgacagcataccagtctccagaataagctgccaccgactcagaaaaacgggatgatcgccagcactcaggggccaaggcatttggcctgcaatagtccaagccagcctctggggcacggaggctgatgtagtctctcagtctccctgtgttggtgacctttttgaccaggatattaaattgtgacaaagttgtttgatgcactcctgcttgcaccaggtaatttattcttgtattaaaagagtaatgtctttctttccacaatggataggggcttgggcaattctggaaggaggaagaggaggagtgtatttggcccacatggcttaaatattgctctgggtaggtgcagtgcatattcctgcaggtgaccctggttttcagtgtcatggctaccaaaatgtcattacccatagcacatgatgcaaggggtaccatgatcattgctgccgaaatggtcttgcccataagtacatgtttatttgttttctatgggctaccatgccctccccaaaaacacacaatgccaccattccactcctcccttgtgggggcttggtataataatcactaagcaacagtgtctcatagccccatgcttgttttcatactctcccccacttccatatttcccgtccacccccacagggcacagagctgcaggtcactgtgggagcgtggagcctttggccctaccccaatcattctttttaaaaggagtcagaatataggtagcacagctcctcctctttatctgagtctagctcataattggaaccaccattttcctcactatctgagctgggtattgggaaactccagcagcagcttgccttccctccagtggggaggaggggggagtatctgaatcttcaggggggcaatccaagactcaaaatccttccaatccggtgagctcccctcttcctgttccttaatggtctgcatgaggtccttcatctctaatttagggggttctctttcctctttatgtgtggacaaaggtcttcagtggagactgcctatctgagtcttatctatcctttgtttagaagccacaaccacattgcactgcacacgagtcctgcccctctgattgtctcccttttgggcccttggaggaccacttgtagaggtctctactgctcaggtctcatccacagctacagtggcttccaccttgcagctccctccatcagatgatgggacatggcagagatgcgtctccaccacctcgctcattgtcatcccagggacagaagaagggacaaggaagtcttccattgtgggggatcctgcctcttaaaggcctctagggctgtacaagataggacagcttcatctacgtcctgtctgggggagggtcatacagccaggtgtcaatggcctttatcttaatggccataatggttttctgaaccattttccagggagccttgcttccaagaaattcccctacagtagcatacactgtgattatgcttccagtcacccaaaactaatagtggcatcagtttgtctcggtcaggtcctgttagttattctctgtgatgtaggtgaaaatatgctatagtagggggatgggttgtcaacttccccaaactacatctttctgctggagtcacttgggtctgcaaggccccctcatccatcaggcacaccaaccaggtagcttgggactctcctggcctctgcccacatctattctttaatttccttatcttgctgccagaaattgagcacatttccatggtttcatcttcagggacaccattagtcctttggcattgttggaaaatggatctcatctgcctgtggctgcagagcctcactggttggagctctgtcctaggggccttcagtctgcattggagctcctaattgttgagccatcggtgtatcagcagtaaagtggccagcagtcaagggatagttttcctgctcgtcttatatctccgccatgggttccaccccctgtctctccaccatatgacccattggcccaagtcatcccagtctaagggaagatttggtaaatctcatttgtccacctatatccagagagtggccaaaatttctgccagctggttacccgctggagagctggggacagaaacataagcccttgcttttggtgagaccgcagtaagtatctttggcaaacctgctgacttccagaaactgtgcagcaggaagatccagctgctgatctcaggggaggattccattcatgtgtaggacagcagagagcatatattgttgacttccaggaggaggatcccacagacttttgctcactgcatcttctacaggtttggagtcaccaagaaggactccatgcacaagggctggttggaaaaacactctacttacagaatgacaagaagatgagcccctcccgataaccaatgcagggtgatagcctgcatgcagccctttaggttacaggcaacgaccccaatcccagcactccatctagtcatatagataagtggagctgtccaggagccattgacacatgtttaagcagtacaaggaaattcaccgtatacccagaacagagaaatatttatccaaataaggaagaagactctgaggccaaggaatagctggacacctggcttctaaattagggaatgtcccaggcccagggcactgattaggcaatcctgtggaatggcggacaggtcacaagatggctgcttcctcagcattatacactgtatgtttatttcttttcttcccctatacattctccagaaggcaggtgctttgctcacagctgtatccttactcattgaaactgagtaatgtctggcttatagttggcactttccatataaattgttgactgaattgagaatgagtaaatgcccttcaccttttccaggcctgaagctcctagtctatgagatgagggcactggacagatgacaccggagttatcctccagctctaacattctgtcactgccatgctgtggaggggtgtcacacatcagccagtggtttaaccatgggttaggagacaggtcagagacaggattgggctttttcctgctcagttttcagatgtcccttttccctcatcttttcttccctgtgagtcccttaggtgtgagcccctctagaggtggccactgcttgtttcctgtttgtgccctcctgacaaaaggtgcagcacctgaactcctgcatgggtagtgttttaccagctctggggcaatggctcttgccttgtgtctgtgtcatgaaaagcactgtcttcagacagactgtctctttcaagaacgctcaggctaagtaactacctgttactaaaactataacattttgccattataaaagtaatactttctggccaggtgcggtggctcacgcctgtaatcccagcactttgggaggccgaggcaggcagatcacctgaggtcaggagttcgagaccagcctggccaacatggtaaaaccctatctctactaaaaatacaaaattagccaggcgtggtggcatgcacctgtaatcccagctacttggagggctgaggcaggagaatcacttgaacccaggaggcaaaggttgcagtgagccaagatcgcaccactgaactctagcctgggcaatagagcgagactctgctcaaaaaaaaaaaaggaatactttcttcttaaaagtaaatttggaaaataataaaaaacttgctaatatgccctccatacaaatgtagcatggctaagatttagaggatttgttcctactctgttttatgtttgtttgctttattgcacaaagtagtgttttgcatttgtgttaatctatatttttttaacttagtatgtaagtatgttccatgttgttgtgtgacttgctttaaaaatgaaccaaatattgaacatctactgatatgatggaaactgaattgggtatttttacataaattagctcatttactgcagcactctagtgaggtggacattattatccctattttgcagttgaggaaacttaaggctcagactgtttcacctactcagatcaaatagctaataaggaccaaagtcaaaattcattggacatggggctgacttgaaaagcctgtgttcttttgggtatgcattttactggctaccaaatatcccatctatcatgccatgttgtgacgcaaatcgaacatcaggtgaggggccccatagtggagctacctgtcacccaagataggatttctcctttcaggcaacttcttcaaagcctaattcagcacacagacatcaggtagaaaggtgattatttcctgcctggataggtttccacccatgcggctctcctatactcttaggtgtacattattgattccaggagtcatatgtgtccctatctgtgttgtgggtaaggagccccacagtcttttctcttgaaagacttggctctggctcagctgtgccttgaatctgtgattctgtcgcataccccaggcttttctgctcaggatggggcccttttgagaccaggtctttggtgcttgctcatgtgcagtctggaatcagctgcacagggctgggaagctgcaccgcccacctctaacaggctcacagcagaattcttaacacaggtgctttattttagaagtttatactcttcattgtaaatagctaataaaaagcgacagctacagcccatttataaatgcacttccagaaaccaaattcaaagggtttactaaatggcaggaacctggtcaacagctgttttaaatgcatttatttctgtcgggaggcaaatgttctacaaaatagctttgttgtcaatagtctctttgttctttgatgtacagcttacaaataaatgcatttataggaactgctaatgtgtgagggttttgatattagtgctaaatttgcaatctataatatatcatctagtcatctttgacaaactcaattgtaatctaattaagtggcgtcttctgtgattctgagtagagatccctaaggtaattctatcctacttggttttcacaggagaaaaaaaaaatccctaagagtactgttcaacaaagtgtgtgtatgtgtgtgtgtgtgcataaaatattccttttagatgagcaaagccaagaagatacctagtaataaatagctttcacagttggttaaatatcagaactggggaggcatttgaccccgaaatcatatggcatctctagagcatggcaactctgggaaactgattgttgcttaaagaaagtttaaagtatttgggaagtaatttctcttttatttttactcccttaggaagatttggatttgcagcctttatcactaacttggtgagaatttttttgtaaagttgtcaaatctataggcctcagaaatggcagttctcatacaaatcccagtaacgatgctaacatcattcatccagtgtcagtcaatcctaggtgcttgaaaaacatctcatttagtctttacaatagcttatgaagttgatacttttgtctcagtctttaaataagaaagccaaaactcagattggtttagtgatctggtcaatattacagagccaggaagtaagaggaggaattgaaaacaaggtctgcccgcctgggagtctgtgctgttttaagtcactttactgtcccctgctctgccacactgcctgtgttttcagagaggaggcaaccactaggctaaatgactatctggcaaaaatctatgtggagttggttcttcctattatattgcatctgtctgggacacctgagtgtttgcagagattcttgccccgattttcagcaccctcagctgttagccgtgctatggatgtgatgttggggaatttctaagattgaagtggccagttgcatgtagatgagaagactttctttaatttgccctaagtagacattctgcgcagtcagtgtgttatagaaagacatttctgggaggcaggtgatccaagggatggtggtcaagaagcacagaatatatagagatgggatagaaacaaatgcaatgaaagatcaggacattttgttcaaagtagaaatttcaagtagggaatcttcctcccacctaccgtcatgaactccaaggagattatgatttaataatccttgtctttatgtgtattcttcagtctatgagtaaaacatgttactggtttctcttctctgtaagttgcagtcatgtccctgcaagggagctagtttgtatgtattgctaggggctttaagatggtgattctccaggctaggaacccttccaagagattctatcacttacccaaagccgaaacacttgtccagtttagcaggaaatatctatatgattttgaatttcttggtttcggccatttgtggctctgaattcactgttgccctgaggaagccatctctgacccaaacactccttgttaaaccactggcatagctcaagtgacttggaaacctcactgtaactactattgcataacttcaacaacaaaccttcattctgttgtggtaaaacttcgctctatattcagccacacattaattagtacttatattttcttaaatgtacactgtgcatcatgacatgtcctcaggatatggagataaaatacttcatttttgctctcaaagacctaacagtctagtgaagaagactgcattctgaagtctctgaatgtcaaaaagtgctggttgaaaatatttcatttttttgataaacatgagaataggtaaaatcattttcagaagggcttatggaggggagacatctggtcctttacaaagacagggtcactgaacccttagtgcttttgtgaggtgacagaacacagtgtccccagagtgatgtatttccttgaaagttttttttctttgagaacatagggtggggttcttcctgaggaaaatattgatattgccagcctgctcctggtgaaattgaaaaaaaccaggaaatttaaacaaaggcatgattcaagaccaatatttaggaggaagcactcaccacaggaccagaacctgacccatggacccttgtactctgcatcgctgcagttcccatgctcttcccagcacctccctaaaatgggtcattctatgcaaatcccaacagccttccaaatagaatgtcactgccctgattaacaagtatttgtatactttttctctaaaatgtctacttgacatatcatatctttttgtatgtttcttccagcttctatttgttctttagaacttcagtagagtgcctttttacatttaccaaacaatgcaaaggacttccaggtaagtggacccctagtaaactctccagtgggatagatgcatagctttgtaatggcagccaaaaccagtttgtaaagatctcattttccccttttttacccctgagaataaaaggaggagtttaaaaaaatctatgcactggccgggcgcagtggctcacacctgtaatcccagcactttgggaggccgaggcgggcggattacgaggtcaggagatcgagaccatcctggctaacacggtgaaaccccgtctctactaaaaatacaaaaaattagctgggcgtggtggcagacgcctgtagtcccagctactagggaggctgaggcaggagaatggcgtgaacccgggaggcggagcttgctgtgagccgagatcgcgccactgcactccagcctgggcgacagagcgagactccgtctcaatggaaaaaaaaaaaaaaaatctatgcacctacacatacatgcacaatcacacaaacataagcacacatatatgcacacttaagcacacagattcacacatacattcacaactcatacatacatatgtatatatatagcactcacatgctcttacaaatatacatataaacatatacacatataaacatacacacatagaaacacacacacatataaacacacacacacacagttgtacatggactgtttcttgggaagaaatgctcattcggcaacagtggcttctttttctctctttgtggatttgctccttggcctttatccctataggaagccaagctgaaagcttttaaactggtatagcttttgtcctgacacctatgtctgggtgacatagattctcagagagagggagagatatgaaaggaaaaaagtctctgaggaaatcgtaatctttcccgaagaagttcttgcctagtgccaggtttctgggctcagagcagattagcgaaacaagcactcagctaagagtccagggcctggtttctagttctggttgtgaccctaatcagccgggcaagtcacttatgttctctgagcctcagatttctcgcctgtgcaatgatgatctttcagattctaactctaaaattctgtgcatgtctcttttccagtgactgaggaagttcaaagtagaataggatggggatgacacatgaataagctctgaatcctcacctgtctcgaggaggaataaattcaatcctaatgccaaaacgacagaatctctttacttcctcactgctttgccaaacgctcatttagatgtatctatcaatcactggtttattcatatggtgcctctcaccgtgaaatctaggttctggaacaatataattggcctaattttggttttctgactgcagaagtggatgcttcctctgcctgtctctactctcagctcttattgttttttttggtgaaagagattaatccaatgctccgtggaagtagatatcaagaactcttgagcagagagaagttttgcattctgcctgtttgacatttacaaggtatttcattaacactgtgggcgattcaatccccttttatttttggctgcccttgctgtgcctctgaaggaaggaaggccattcttttgccaggtaaggggcaggaaaatgtgtgactccaaagctacctggagcctgatgggggttaggttggtccttgctgcccctgctggtcacatggtccctgcttactctgcttgccttttgtcttcctctttgtggactcctattgatccttgtacttcctctggcagagtgtttatcagattatattgaaattgcctgtttacttctgcctctcccacagaacagtaaaaacctcaaagactggggctctttctttctttcttttctttctttctttttttttttttttgacaggttctctctctgttttccaagctggagtacagtggtgcaatcacagctccttggactcctgggtcaagggatcctgccaccccagcctcctgagtggctgggactacaggcatgtaccaccatgcccagctaaattttaattttctaatttttttttttttttttttttttggtatagagggtcttgctaagttgccagagtgatctcaaactcctggcttaaagtaatcctcccacccaggcttccaaagtgctgggattataggcatgatccaccgtgcccaggcttgttttttattgtacacttagggacttgcctatggtaggtactcagtaaatgtttcttgaaataattaatgacttgggttgatttggatgaaagacggaatggacggagggcattttttagtagcctggagacttggtttccatgcaccatgctgggatgtccctggcagcccatctactgagctggcaccagcatgcttaccagtctcctttgtgacagtcccaatggatatttttattagccagcatgatttatttcataatgctgagttgcagcacccttcatggctagagatttttgctgtggagataagttcttagaactatctccatttccagaaaagagagggtttctctcgtctgttgcccagaaaagaagtcagtttacgtatgcatcttccctgggtcaggctaagaagtagccccagcactggcatgctagacttggagagtctaatattcttccagccaaaccctgaagcaaaccacacctcctaggtcctgcaagtccccattaagtgtgcttaagtcatttgaactcctagagaatccatgtcagaggaggagaatcagcattcaacaaaagatagcatgtagtttttttttaaaaagtgaaagactaaagcttgccttttctatagatcatcaacatgtttacttatagcaaaaaaagcatgtacagatggatttttgccatttaaatcattcattaaaatccctattttaagccaagatttataacaaagtttttggggaaataacacatacatcccctcccatctggaaatgaaaagaacaagcaaaatggatctagcatcttcattataatagcaccttagcatgtaattcagtctcctcatgacaaccattatgtaaggataaggagaggctctgcaagccacccatttctacactgccctagagttgagattcaaccaagacccctgcttcggtttaggtttcaatatacacgtgaagacagggaggaatatactcacaagacaaagtcctgtgctcattggcacctgatcaagtgctaaggcttcagatgaaaagggcaacagaatctccagggcaaagggatcagttagtggaggattctttagagaggagggaagagaccccctgctgggccttgggggatggagcatttagtcaggaagatgacatcccagtaaggggaagctacccctaaaagcaaaggtatggagatgggagggaatgcggagaggggtggagaaattccatctttgttagggcagcagtcaaggatgagtgagttagcctcttaaggaagaggctaagctgttagaataaagaggtttacaacatcagcggcttaaatcaaatagaagtgtgtttctctttcacatgacagagtagatgtggcctggcgtctagaaagcatatttgtctctgctccactgtgtcttccagggacccattcttctcttgtcttcatgctccatcacttcctagggtgttgtctacacctgcatagccatagctaattttccattctcagcaccaaccaggggaagaggaggaaaggtagcctccttttcatgataggtgtgaagttatgcaggacactctcagggtgaatggaccacagtgtggctcctgactgggcagggaggaagaatctgctgctagagaaagaagggaagacagtcatctttgacatcatgagttgcataagatgggaataaaaactggaaaagacctaaatcaccatattagaaaactctagccattctaaagacattgaagaatcctgtttggacctttttagcagtgaggagcgtccagctgtggttatctggagaatgcaataggcagaacttgctggtagaggccccgcttccttgtcttgaatgcctgcctttttttttttcttttaaatttttcatctgcttctggatcacattgctgtgagccacattgggtcaattcacatggaggattagatctgggcacaccgtatcttttatgtcttttatttctttgactttattctgctggaaagtgttggcccacagccagaaccggcagagggcaaaggagggattactttcttatcacagggaaattaaatgcctgagacagcaacatagtgatttttttaaaacaaatttttaggaaaattgaactcaccctgtttactttcatagaaggcttttgggctgtgggaaggaacctatttttgtacttaatgaaatggatcttggcagtaaagggtttaaaactaactttggatttatttaaaaagtaatatccttgccactaacttgtcttctgtctttaaaggaaagagaatttttacagtgcctatagagcatgccattcctcaccagtcatttggcagtcctattagcaaactcatttgtcaaagcctcattaggtgattgcaaaagtactctcccaggacccactttggacttcttaccaagtcgtgtgtgtgtgtgtgtgtgtgtgtgtgtgtgtccgtctgtgtgtgcatgtatttgaaatggaagtgtgggaacatgacagtgtagacaagcttacagcccccatttttctttgagtggccccctctgataaaaggttatatactggaagaggacttaaaacctttgaaaaatcaaattctcttggaatataataccaaagtgttgttgttgtttttcttgcatctacatgttccatgaatattttccaaacaattcaatacattactcttcagcccacgcccatgctgacatcaaaaacttttgggaagaaaaattgttatcgaatagcagtgtcgcaccaagcagatggggtcactgtcccccaggataaggcatttctcatgtgcttgagaagaagactgtggatctgaaaatatgataggggctgcggcttattgaggcctcactattgagagggggcttggagttatggggaacagtgggctctagtgcaggactgctggggtcttaagcccactggaccacttcctagcttgccagccttgggccagtttatagccttttgggcctcagtcttcttatctgtgagaaagtgtaatgtcacctcccatgtcactgtgagcagtacataagtggatctgtgtaaatagcttggagcatcatgtagcatgtggaaatgctcagtaaatgaaccaggtctctcaaactctagggcccatgtttttccccttcaccactaaaacctcatgagaagcatgggctcaggagtagcaggaggcttctggcacagaatgagaagatgggaaagcgtgctgcttggccacaatggaaggaggagaaaggtcaaggagctcggtcagtaatccccactctgaggccaaggaaagaggatggaggaaagggcaaccagaacatcaaataccacataagcaagaagccataagtttctttccaaactaacagttaagaaaacagacctaaccacttctactcagggactacatcttatttgtttttgtatccatagtgcctggcctctagttgaacttgacaaatattggagtgtgttggcctgtttcttgttcactcatttgttcagtcattcaacaaatatttaagtgcctatcatggaacagccactgctttgagagcttacaatcaatgctgaagaaaacaacacggaaggattccccctgccttggcttcacctgggaggggagatgggcagtgagcccatgctagcttctaatgcactcaccacttcttttaataaatacaatactctccccgcttcccctaatgattctgtgaagcaaactagtctatagttcctggtatcttcttttcttgaaaagttgacatagatgacagttgtgtcctgaagtctgatagcttctatgaatttctcaaacattggttaccaactggtttggggatcaccttgacaaactgtgtaatttagaggtgagggcctcctttattggagtcaggagacctcttggatttgtgtcttcactctgttatgagttgagtggcctcaggcatcttctgagtttctcattcctttactgaaaataataatgcttatcttaaagtagcttgttcagaacttgccttgtctcaagaatcagccagacatttataaacaaatctgaatcctgaacgtcaacccaggcttgtctaagaattctcctctttataatttttagctgctcagagtagagagcctgtcaccaaccctcacactgttattacagtttcctgtttctccttaacatttattccaccacattttgcacatatgactttagaccttgaactttcaagtctttctagaccaaaggacaacaatgctttccagagagtccagcaggaatcacactgggaaagctaaaaaagcaactcagtccttttcacccagtctatttcatccaaccccgctgcccctccttgaatcctggaaggatcatctattgcctttcaactcaaagtgtgggacgtgtactagcagcatgggcatcaccagggagcttgttggacacgtggagtctcagactccaccttagacccactgactcaatctgaatcttgacaaggttcctgtatatcatgcatgttactctttgagaagcaccagcctgttgaatacctctgggccaaaatactattcagatgtgttgttctttttcaattacggaaataattagtgacttaaaactcacttctgattcaggactgcatggctgtttaagtcgatatgtctgcgttaatgctgttgtaatgacatcacagaattgaggcatttatgaactggagagtaaattctatatgtgtttaaaaattagataaataagaatttacatgacagtttaataggggctttaaaaatttaacacggataagtcatctgctttttcaatggattttcctgaatagtgggatcacaaaagaaatttatgtgtttttctaagtttctttttcttttaatgtggatttacaagtgattaatttaaaaatttgctctctgattagcaggtaacatttataatctggacctgtacctaagatagcttagcaaatgaacacaaatggcttactaggtctttgcttttgaaaacgtatggccatctaaaagtagtaaaggcaatttaataaatacagacaatctgctaagcagccaaggaaaaaaggtgcctgaattatatatgtctgcatgagtggacaagacgtgcttttcaagattaatgatttaagctgttctttacgttcccagactgattaaacaaggcttaattctaaacaacactttctccttttcttgcttcttcaaaattcactgtccttctctatcccttcaggattgattgcaggggtgatccaggatggtgtctgtctaaagccttaacttctctcccttcataaaaggaagattatcccttttttaattccttgttttcattgatgtcagatgagaggcattcagaaggagtgttagcattcactgcactttccctgaaagtggctcaacttttgattgagatgttcttgaagattctgttagtggcatcttggcatgctcctgtcctctctgactttgacggctcctcccctcctccttcttttctccctcacactcctgtccacacttccagtcaagtgctttccagagcctgtcattcagtttcttttctctctcccaaatccatcgtcttttcccaatttgtaggattttttctttttccctcttgttcagcatttcataaagttagtcctgccaggttttaataggggttccacccccctcaccgctaaaaaaaattgatcaggacaaagtataaaatattaatttagacagttaaatatcattttgtttgttggtttagcctcaggacaaattagaacttttaatatgctgccaggaggggttgggtggttttctcatttctgaatttatttccctgtagaaccttctttgaaagtatctaggaagaccagtgtttgatgaaatgtactttccgacctcctccttgacatctctcctacatgcttctctccatctcatgctatgtctaatgactccgtgtactgctccacgtgtcacatcctcaaatacatcctaaattaaacactaccaacattagctaacttctactgatcactccccccacttctttttttttttttttttgagactagtctcactctgtctcccaggctggagtacaatggtgccatcttggcccactacgacctctgcctcctgggttcaagtgattctcctgcctcagcctcccaagtagctgagattacaggcacctgccaccatgcccagctaatttttgtatttttagtagagacagggtttccccatgttggccaggctggtctcgaactcctgacctcaggtgatccaactgcctcagcctcccaaagtgctgggattacaggcgtgagctgctgttcctggcctgatcactcacttttactgctaaggcttttaaaagtattttgcctctttgattgtctatgaaatcaagcacagatatcttaacctgagatgcaagaccatgtgtgttcttggaccaaccaacttgcaatcaatcttcccccttccccagcatttaacattcttctccatgcttgatttttctttatgacagagaactttacccctcccaatattctataccgtttacttacatattttgtttgtcgtctattttacctcaactagaacgtaagctccatgagactgggatatttgtttgttcatgctgtgtcccaagcacctacaacagtgtccagcaaatggcaggtgctcaacacgtgtttccaatacaggcggaatgaatgagggagccttctcagtttcatctctggcctgtgcttggtctttattccctactcttctcttgcctttttttcactctcttttagccctcaatcttcatctgtcatcatctctcttcacccctcagagcctaactctctaagtagcatttcttccaaggagccttctgtattcgtgacccttctctctttgtatgggtccctgtctttggaatgttgttgtttatacctgttttaccagtcagttacattctgccttgtagtagagttccttttaagctgaaaaaggataatggggtattcatgtttgcctcttacatcactgtggaatatgctcagtaaatttataattaatagaacaaacccaacattgtgcttccaggaaagtaacccccacgtgtgcctcagtctgtaccatggggactgcttgacgcatctgtttcctcagttgagcccttaagatgaatgcttgatatcctcaagaggctattaacgagaatttttatttccccaaagtttctttttccctaaaaggcatttctttgatatataacaaagctctgttataaaaatttcaactgctcatcccagtaggagagaatgttctacgaattcagatataggaaggtttccggggctatattttcttttctttttgggttttcatgttcacatttcatctacatttcccctcttgggcaaataggttgcccaatttagggcaaatttgtttggttttccttccgatatctttatttatttttctttattatttgcttcctctcccttccctccaagagagttcagatacttaccacaatggataaacttatgctgggaaattgcaatgcttttctttttttgcaaagtacagacctcatgtacatatgaaggctgctgacactagctttccatctggccacaggaaagtgtgtcatctctttcttccattgcctgtctcctgtccccaggggcctcagtggaggccagacagtaacttttctctctttcaaaaacccacccaaatccccagaccctttctaatacagcttttccacgtattcatgtatcaccacctgaaacttgttccattctaagttaaggattaactaaatgaatgaaaattgtatttatttgggagacagaagtagcaaaggcttagaatcaggcagacttgtgtttcatcctcagattctcctatttactcattgtataaccatagttcagtcaattcccgttgccgagccttagtttctttgtctgtcaaatgggtataacaatgcttgcctcatcatattcttgcaaataaggtcagataattcatgtaaagcttggagcacagtgtatggcacctggtaatcggtctctctatgatgaagatttgctgatgctgctgcttacttttctggcttatggggcttaggttctgaatctttataatctttttgtgcctgctgcatatggtcaaatcatgtttgtttgatagacagacatgtggggtttttccttaacaagccattcaaccatgtatagtgaagaattgctcatggttggtctgttttccatgtctagatattagaagagaaggctcaaacatgaggttactctctgtagtgcagtgggaaagagtatattcccagggagcctggcatcccccattaatctgtaagcagacctataagcaaaggaagggctttaggataatccccacttccccgccccaccagctttattgaggtataactgatgaataaaaattagatgtatttctggtgtacaacatgatatatatatatgcattatgaaatgattaccacaatcaaagctattaatgtatctatcagctcacatagctgtccctccaggttcatccatgttggtgcaaatgacaggatttccttcttctttaaggttaagtaatattccattgttccattgtgtatttttatcacattgtgtattcatatttctgtattcattcattgttccatggatatctaggttgtttccatatctttgcttttgtgaagaatgatgtgatgaccacagggctgcagatacctctttgagatactgatttcattcctttggatatgtacccagaggtgggattgctgggtcataatgccattctaggagttgttttgcacgttgctagatgtttcctgaatgatatgagaagattcttaaatagagggaacctccctagagccagagctcacctggttgattcctcctaggagggacatggtggtggaaagagctctgctgggaagaatggggactcagctcttctgcatactgcagtgtgactcaggcagacactgcacatttctgggctgcgtttccttctcctcaggatgagaaagcaaacctagactgtctctaatatcttacagcactgcagatcctacccctgcctttttttttccagcctccatctgagagcctctttctgtttctggtaagggtatcttcacccgtcaccaccctggtgggctggcttttacgttgagtgctttggtgtgaaaagcaggcttcgttcaagttgacttcaactttcctctttaaccttttatcatgtgttcttgttcactctcttccttcatggtgtcaagtaaagccagtagggatgaatcaggttcactgttcttttggagatgtgaaatccatgaatggggctaggtttcattatgtctccctctgggtagacccaattccctcctaattgcctttttcctgttgatcattcacatcttctgccttggaatttctttgaagttttatcatgttctcccttcatcatgtccttccctttgtgacttcagattttctgtgggtagctgtaatttcctgcagaacagtgtctactagattccctctgagcatggctggtgcagtggtaggattctgtgaaacgttgtcagatgtgtgagtgtgcagattgataaaacagcgtacactccctgcttcgttcccacctctgttttatgtggatgatgacaattacagcacagcacctcatatcggtgcagagatttctcctgctgtgatctaatggtggtctgtgtgcatgtggactgggaaccagaaggtggctttttctaggagatcttggctgcaggcaagcctatttctgccaagctagggattgtccgggtcttgatagagctagctgttttgtaccattgttagtagccaggctgtaattctgacatttcaactacttggactctgaaaaggtgtggttgggccccagatcatcagccaagtcttccactcagcctgcttcatgacctgacatgcttagcatttgggcccctttccaagagtgaagtaacacactgatggggagacaagaaagtgaaatagtggccccttggttctcacggggaagaggggagatgtgttcaggcctccccttcctccgccttcattggtggttcctaggtgagaatcactgggaatcaggaggatctatcagaactgggaatcaggaggaaccttcagatgttgtgggcaaacaggggggcaaggggtgacgttaaaactaggctttgtcactttcaaaagtctgcattacagtcagccatggagaaaacggcctactttctacatcacaggcgtggcttaaagatataaggccaggccatttgaaaaggtttagtccctcgtagaaaggcatacaaatcacccctcctagtttgggttcccacagaggcaggattccagtgtacatagtttatgtgggagatgatcccaggaaacttgggaaggggagtggggaatgagaaggggaggaaggaagccaataaaggatgtgctatcaagctcgccatcactgtggacagctgcagctcagttccactgggaacgtctgggaaagagtgtagcacaggtgcctctgagtgatcacacctgagaggggaggttctgctggccagagaacctctggtaaggaggtgcaggggctggcagttggtcaggcccatgggcactgttacaatgaaggctgagggaaaacgggtggggcatcgattgctttgctgcaggtcccatcccggattcaccttcccagggatgctagatgggagtctagacattgtctctacagaggatgaatctggaattcagaaagatgatggaggcccactgtggagaagccggttcttgagagttgggtgagaatccaggcttcctgactcttgctgcagtgccctttccacttggctacttaaggcagaaatttaaatttgtgatgacttttgaggcatactgtacctgattcatggaacaatattgtccttcccaccatgggctctttagtctttcttggagtgaaaaattgtcaaaagattaaatcctatttgggagccagagaaaaagcaaaagaatggctgagcgtgtaaataaagtctcctaggaagatcatatttttgaaggtatttattattcatatctttttgtcattgtcgtgttgtaagtgtttacctgggcttctagctttttgcttttccaaggacactgctgatccatcctagaagaagctgacagccaccaccttgacactggcttattgctgtccaggttatttaagatgcggaggaaatcttatcacagagaagcagcttctaaacatgtcctgccaggtgggtgatgaggtaaagactgcccaggcggccttgtgcacaccacatacttgtggagccactttgatgaaagggtctggattatttgcaaagtcttgtgctaggtgaaggtgggctctttcttaaattctgaaatgcccacgagtctttggtaatgttcatagtgaagcatctgagctgagcctgaggcttcccaggaggctgtgccaaggacaaaacacactgaggatgttgaccatggcctcctgacagaatgaaaggcccccacagtttcaatttaaaccgtaaacatttaaatagaaaatgaagtgctggtgtatgactctgaacttgtgagactagctgaaaacaccattttgaccgttgggcagagatttcccatcatgggatcagccatagaccatatccactgggaacatggagaaaaggtttagaggttccaccaacattttccttaattcttagatgccttttggtggttgaattctgtccttattttcttatttcctgaagcccaaaatataagctctataatgtggtcattcataaacctttagggatattcctattggaaaatgttgtgcaagtcttattttagagttcccagaagggaattaccggaccttaagatatgcacgttttgaagatattggatacaactggtctccagaagtgggaagaccatttttgctccttttaatagtggtgtctggtgtctctttcctcagatattcagtaatggatatgtcatgctttttcattttgcccttctgataggtggaaaatgacgtaacatccttaatttaagttacattttttggatgccattgtgaattttttttcccctatagctattgcctatttgcataccctctgaagttgcccgttcttgaaggacactgataatgttctcctcccctgccctttcctttttgttgccagaataacctaatctaaaccagaaactccatcttttcttccccagggctcctatagacccataggcggctagagtgtacctgtgagcctctggggagatgtctcaccgccagagagctgtccccaactcaggacctcacctgcctgtgcgtgcgaaattacacctgagatggagtggctgtgtccagctaacaaagccgtttggggaggggatttcaagcatggctattccttgttcactttaataaaacatggcatgaattcaggcaaagggacttactccttactccctcacctcagatttttctgtgttttgctgttggtataacttgtcctgtgttgctaagttttaaacatatctatattttgtttaaaacactaaccatggctttgtttgagtggcttatttttatgtcctaaggagttgacctagacagggaacagttagtcatattctgtttcaggccaatgcctctgagccccttcccttctcgtttttctctgtctgaaatgatgctcttggctggccccattttgctgtttgtccaaacgggcgcccctcagcaatgggcaactttctccattttggtgtcttatctaagaccttgcccactggcttaaagagttggcttgggttccgtcacagtgatgagttgcctgtcccgccgtctgtagtcgggagggctttttccgtgatgagaatgagctgcaaactcaggcaaacactgatcaggagagacatgaaacccaacctggcccagtcggcttaaaaatagtccagtcatttcacccctggaattttctcttgcttatgtgggtggacaattctcttggaacaccaccaagatcatgaggaggagaaaacagagcaggcaccaaccacatgaatccaacccaggctgaccccgtagccggtggtgcattggccctcacaggtttgcaccctgcatgcagggccctttctcccccacgagagggcgctctcgtcactcttaaagcaatcgtactggggaacactcaggttgtttcttagtgaagtccccgaagagcactgcatttaagctgctactttgtgtctcagcttctactttcaaggtttgttatgaatgtaaagacattctccaactcaagcaagtgtgggcaatattagtgtctggaaacgcctgttgcaaatgaagcacagccactgcttgtttgtgtttcgttagtgaaacgtgattgtaacccagggtttttgacgctcacagaagcatccgccttggtaatgctgtacatccaggctgctcttctttgtccctaacctggttgcaatgtggccgtagcatgcttgtgttgacatctgacaggagatgaggacttgacttcctgggctgatcttgcttattttggggagagcaggagtgcccgtggttagtgtggatcagcctgacaggagattttctattgagggaggatttaagactgcatgcaggcaagggaaatacaagccatatttcaccagctcaatacaccagggagcgctaccatttaacgaaaaccaccattctgacttccgggtttttaggtcatctggcagccactgggtggggtcagtttcttggcccttgattagaagttccttctgattacaaaacacctcttgattgaaatctttgcattttctttgcatttgcatttccaccaatctttttattttttattttttttgccttggaggatgtgtgtatgtgagggtgaccttctctttatttgtgggaatcggggagtgccctcctccctacaaagtcactataaagctacgggctttgctgcccttggtacagggtctagaagtggttgttgggtggtgaccagcacagtgacagtttatttcctggacctttgaacctaaattcccacaggaagaacataaaggactcagcaaatcttgccccccgacccccgtctcctccatgcgcctacactggagccatgagtactactgctaccgtcactacagccaaattattatagagaattactatgtgccaggcatgggtaatttttggttgttttaatcaactttgtttcaaacagctttagatttgcagaaaaactatgaatatagcaagagttcccccactttctcctttttttatttattttattttatttttttgagacggagtctctgtcgtccaggctggagtgcggtggcgcaatctcggctcactgcaagctccgcctcccgggttcatgccattctcctgcctcagcctcccgaatagctgggacgacaggcgcccgccactacgcctggctaatttttttttttttttaatatttttagtagagacagggtttcaccgtgttagctaggatggtctcgatctcctgacctcgtgatccacctgccttggcctcccaaagtgctgggattacaggtgtgagccaccgcgcccggcctcctatttttaacatatagtttctcctgttgttgttgttttaatcatattagcataacacatttgttacaattagtgaaggaatattgatacattattattaactgaagccaatactttattcggatttcctttattttgacctagtgtcctttttctgctccgggagcctacccaggataccgccttaccttagttgtcatgtcttcttaagatcctgctggcggtagtggtttctcagactttaaacttgtttttaatgaccttgacagttttgaggagtactgctcaggagtttagtagaaggttcctcttttggaatttgtctaaggttttctaataattagactggggttatgggtttttgagaggaagaaggcagagagaaaatgccattcttatcacatcatattcagggtacatattattaacatgatttaacgttgtagatgttgaacgtcatcacctcgctgagacggtgtttgtcaggtttcttctcgtaaagttactgtcccctctcctttttttatactgtactatcacaagaaagtgaccacgtgtagtccacacttaaggagggggagttatattccaccctcagagagcacagtacctataaacatttttgaaatttctctgcacagaaaatttctctcttcttccccatttatttacgtattcaattgtttatttctatcaatatggactcatagagatttattccatactttgagttataatcaaatagtatactactagattttgtttggttttttttttgcctctgggagctgtttcacgtgactcctgtgtccctttgacacacccccatcattgcgggtttttgtttttgaggtgtttctttcttgctttctttgtggcactcactacaagatactccaggattatcttgtacatcttctgccctagtccttgaatcagtcatttctccaaaaagccctggccttttttttgagacggagtctcgctctctcgcccaggctggagtacagtggcgcgatcttggctcactgcaagctccgcctcccgggttcacgccattctcctgcctcagcctcccaagtagctgggactacaggcgcccgccaccacgcccggctaattttttgtctttttagtacagacggggtttcaccgtgttagccaggatggtctcaatcttctgacctcgtgatctgcccgccttggcctcccaaagtgctgggattacaggtgtaagccacggcgcccagccagccctggctccttttattggagggtggtattagaatagggtctgggctccaggtgtgctggtgcttctggttgctgctgctttataagctctcagctgacagcaagaaaacatgtgcatgtgaaccaatctatagatgcctatctactgatctacaaatatatctgtatgtaaccattggtatctgtattatgctaaacatgtgttcacactgacgtttccagctcttaagctgttacatgtctccagctctaagccattatcacgtggatcattctagccttcccccttgcctatctgtagcctcctactccaaaaatgataaacttggctctcagcatctgtcatgcatttatttagttgttcaattccagtatacatatgtagcagtatcaaaattgttaacttatacccccatggaaaatagcctcgtcaactagagtacagtgcttgtgtacggtttattttgccttagttttacagactgcatacatttccaaagccacttaaatagcacctttttcttccatccactttagtgagggttgttcacatatgtaccacagattgctttgtcacatgctgtatttcattccgggattaccctgactgcctaaatgatttttttaaagtttatatatgttaagatttgccctttgtgctgtaaatttcaatgggttttcacaaatgcataatattatgtacccaccattacagtaatgtacagaataactataccaccctaaaaattcatctattcacccatttaactatcctccatacctggaaaccatggattttaaaaaactatctacagttttgccttttccagaatgccatataattgtaataatataggatatgctattatgtctccactttccacttgaggactctgaccttagaactcatgattgcccacggtttcttggcttgtaattggtgatgctagcgtcaacccaagtctctgatgttaaaacaggaactctgaaactccccactatgctgcctattttccaatgaaatgggtccaggaagccatctgataaatattttcactaggttgtcaaaaattaataaacatgcctctttcattaccttcggaggccatctgtggggtggttgtgagtcagcctctgcagccatgctgccagaatttgaatcctacctccttcacttcttacccatgtgatttgaacaggtggttttactttttttttctgtctttcctggcttactaaacaattcttcctttttaggaatatatgggaggagggatctgtgcaatgcagttctacaccctggacatagcaaccgactgagtcaggccaattaacttctctagcctagcgatttgaaacccagagccggggccctctgacatgaaggcacctttatatcttcagtctgtagggcaggtcataacacctgcagccacagttcctggggtggccccaagtctggatgcttagggatttattaattttttgagcaactccagtatcttaaaaagaattcatccttctcttccttttgttgttgttcttcttttattcttatttttaaaatttaagcgaggtaaaatcagcccctcttggctacaggtactttaattactacaggagatcatagtagctacctcactggtcataagggttaaataagataatgtataagacagttagcacagggaatgagggaattgtcagggaataagtacctggtaattagtagcttttactattatctaataatagttcttgatatttacttagtgctttgtaatgtgaaccatacactcctgtgtgcttatctccttgacaattgggtggaaatggcatccacattttatggatgagcaaatggccatgctttggggtttgcccagggtcacaaagctggcaagggactgagccaggatccccactcaggcccttcgtcatgtcatgtatccagggttctctccaatgtgccagggtcgtgtggtttcctgggggtgtgatggagagggaggcagtttccctttcccattttagggacaagagtggagatgggaaagtactttcctggggacagaggatggaggtgaaggtggtggatttctttagttatggggagttaagttgggaatgttaggcctctagtcctttccttttctcttttcttttctttttttgagacagagtcttgctctgtcagccaggctggagtgcagtggcacgatcttggctcaccacaatctctgcctcccaggttcaagagattctcatgcctcagcctcccaagtggctggaattacaggcatatgtcactggctaattttttgtatttttagtagagacagagtttcaccatgttgaccaggctggtctcgaactcctagcctcaagtgatctgcctgcctcggctttccaaagtgctgttgttacaggcatgagccaccgcacccggtctgggccctgagtcagtttctgacctgccttctgagctctgcatggtgcctggggtcagcctgcttctggcttcaccactctctgttctactgcatttattgtgcaaacagttgattgaatgcctgtttatgtgccaaacactgtgttagggaagatgaaaggatagatgagacccattaaggtctgccctttaaaagcttgtaatatgttggagaaaccagacatgaaaacaactaagtataacacaacataatgtctgaaagataaaaacaagtgttttcagaacacaataattcacagaatacctacacatgccataaactgtgctaagggttttccatggattagctaatttaatttccccatcaaccctacaaaggaattactgtggttgttctcatttcacagatggggaaactaagcacagagatgttaaatcacttgctcaatctttataaagataggaattgtagagttaagttccagagcctgccctgttaatgatggcactaaactgccttccagagaaggtcagaatgcatagctctttgtaggattgttggtgaaacttgcagagaaggtattttctgaactgatattcaaggatgagtaggaatttataggtggatagaaaaggaattgtattccaagtagaggaaggaatgtgagtggacacacagatggatgaaaatatataatgtgttcagggaatggctagtaatcccagaggtcaagagtggcaggcagtggttggctattacacttaaaaggttaaagctaatgccgtaagcattggggagctctcagaggattttaagaaggggagtctgtgtctagatacacttcaaaagggttcctgtagtagcagtgtgaaggctggtttgggcatgtgtcagaatcatttgaaagccaggagggcctgctggaaggcctcgcaatagtctaggtgagatcatgcatcggctttgggatgtggcagtagaagtgctggcttcttgtggttttgggggttggtgcttcacagagtgaagaaagaggtgtcacaagggtcattaaaatcccactggtgtgcctgttgatataggaggcacccatcttactctctaacggtgttctacaaactagccaggctgtgaactgttcattactgtttgggccaaaataaggggcttgcaccagaatataaatcaatgcattgcttccatcacggagaaaatcttggtgcacacacacacacagtctactgaagcaaaaagtgtgcttagtgacaaagttgatttggattctagtgcaagctcttatttccttgcagcccacaaacaacatgtggactttcaccagtccacaaccataaatagagtaatgctgctgtataatcaacatatcttacttgctctatacttcaaatatcttcttctctacagctgaattttgtagatgaaaaatttattttaaagtttcaacattttaagaggtttctttttactctacaggcaagccacttatgtaaaggacccatcttttaatttttgagttttggaaacttacatgagtacttaaccttgattaataattgataactctttctgtagagatgggccggtgacctcttgctactctccagcattgttaagtgctattgcctttcagacttcagattctttccaacctctaacacttgggccattattccttctccaaggttctcagaagtgatagagcactggagaggcaatgaaatcaatgatttctctatcacttgagtgtaaagtgtaaactaaattatcacttagcagccatgttattaaagggattcaaacattggtaaagtgtctggactaacagactttcaagattctttgcaaccccgaggttttcgatttgtcggaggtacagaactggtaagcggcagagagcggcagcacctaggtttcctgacccttgctgcttgcttccctgccgctcccctcagtccttcatcaagagctgcagaacaagttccactctccctggaggataggtgctgtgggtcttcatttaatggtgggacctctggagatttttctctctgctaatcacccaaggatgctttacatactctactgagatctaaatttatattgcagatgggccgatgctgatgtcttaaagtacttgctgggaagataatacccaatctctggagaaaagagctttacatttctttttactgagggctgttctgtaatttggctctcctaactctggcttgccccaacaatgagctacgtaattggccttaaagggacacccattgatttggacagggtctgtacatacaccagttaaacacagtgcctcatgctgggtctgtgtatttctactgggctttcttttctaaatgttatttaattccagagtttgcattagtgcttcagtcaaatattgtcaggctttggtcaaaaacccttaactgaagatcagggttggtcataaaaagttggaaatcgacatttgccaatgccaattggcagacagttggcactcaaattggggacagggccaggcaaaaaaaggtcttcaaaaactgtgctccaaaatcctctaaaatccactgtggttgcatcattgcccaaacttacagcttaatatgttggctttgctgcttaacagctgtgtgaatgggcatgttacttaacctctgtatttctccatcataagatagacataataaatttaaacccatgggttattgtgagaataaataagataatccatgtaaaagatgctcagcctagtccctggcatatggcaggtactcaagaaatgtttaatttgaatctgttgcatgcgcattctccgttgtagccagataagtctctctgcaccatgaaatgccattctatccctgcctttatgcttttgtttatgagcagaaggaaagtatgacctaatgattaataacatggcctttgctgtcaggcacacctggctgaagttttgttttctctgttgcaggacgcgggtgagttaattagctattttaagccccagtttcttcaccgtataatgggggaataatggtactgaccttacagtgttgtagtgagggtttaaatgagataaaatttgtggatgcctggttaagacaatcatgagccagcttattgagctcctattatgagttggtcctggaggtagagtggtgagcacacccagctgggtctaatggatgtataaccataaacagttacaagccttaaagtaaatatttacaaataattacaaaggggcaatgtatgtaagtgccaggtgagcagttagcaagggggcccagctaggtctaggggtcacataaaacttctcagttaccttgaataccatacaggatgtagtattaaaggttgacgtgaaggacaaagaggaggtgaccaggcccagagctggggaaagactgtccaaggcaggggaatagcatgtgtgtggactcagagaccggagagcatgcgctctgttttgaagagctgagaaaagtcctgcgtgggtcttgtaggtgttcaatcaatggcaactgtcattattctagattccctctcagggtgctgaatcctaaagcagcttgagtgcctaccttaagtctttttctctttttaatgaagcttcctttgactaactcagaactgattccaatctactctaaaaccttatagtattttagtcagtgctatatagatcaacacttagttatatgattttaaaagttgttcttgaagttttatgtatctttcctgagtcatcaaattgattgaaaattcactgaagagccctgattttgtattatgagtctccagagggcttagcacaatgctgagtccacagtgattaacaaatatgtaatgcttgttgcagaaatatatcttccacctaaaattctgtagtgtaccctgggcagtgttgggagggtgtacacttgggacccagattcgacaacttaaccattttctatgtgtataatcttgggcaagtcattctttttaagcctcagttaccttgaataaaaaatgaggatagtaccatagttcatttactgtaagactcattttcttttcttcacattttaacatctctaaaacttgaatgtgtcttacaataaatggcatgttatagtttaattggcagtattttttttctgtgttggtgattataaaataatggtgtgtcttaaattcagtgacattttaggtttgatgaaataaatacaacttttacattttaggatggttatgaaaattcaagctaatttacacaattcatttgtccacaattcatttacctgatgttggcatgacagtgaagaggtagctgcagacaatcaaaatcattcctgtgatccagtacaagctttgctaactgccaaagttaaaaactgttacggccgacatgcatgccagaactcaaaagccacctacctttagcctcaattcctccagatgtattttgctacttttacacattgttaagttttgtggcataatgcttaagatgttggatttgttgaggagttcccaccctcctaccctagttctaagccaattgagaaataaggtgaaaaaccaacagatgaagaatcaaaatgtcactaaattctagattgtagtgtgtagcttatatctatggttaagtgggctctgtgatactgagccccagaattacctgtgcatttagggatatgctgataggctgctgctgtgagggtgcaaaggagaatgaggatttctgtgggcagcccattccaaggagagagggaaagagctgggagctagactatacatgtcactcacagatcatgtaagtcagtcttcaggccagtaaagaaactccaatagggccctgcccaactaaagggaacttctggggtggggcagcacctggcatagagtaggcttttagtagatggtagctattagggaaaatcatggcagcttttgagaagaaaaagaagttatcccaaccttcaaaaatactctgttttttacattatgtaccccttaagcagacctttaagggcatgtatgtttgtctaggattcctaagcattattttcattaaatattgttagtccagtgattacttggttggttatgcagttctcaaatcaggtggattttaaaacattaatatctcagcaatctttaaatacactattcaaattatgtacttacagtaagtccataataatagggtgttgcaaacacaggaattgctatcataatcttaaagataaaaataatttgagtaaataaattaggaaggggaaaggctgatgttagtcaatgccaaagctgattttgtagagccagaatgaaaaaaaatatgtgattgaaaaatgtaggcatctatctgcaagactttctaaaaaaaatgcagatagtagtaataaactgcattgctggagagaggggactaaaatgtgtgtgtgtgtttttaagatttaacttttaagttcaggggtacatgtgcatatttgctatataggtaaacttgtctcaagggggtttgttgtacagattatttcatcacccaggtattaagcctagtattatataggtaaacttgtgtcatggggtttgttgtacagattgttttgttgaccaggtattaagcctagtacctgttagttattgttcctgatcctctccctcctctcaccttccttcctctgataggccccagtgtatgttgttcccttctgtgtgtctgtgtgttctcatcatttagctcctatttgtaagtgagagcttgcagtatttggttttctattactgccttagtttgctaaggataatggccttcagcttcattcatgtccctgtaaaagatatgatcttgttccttttaatggttgcatagtattccgtggtatatatgtaccatgttttctttatccagtctatcattgatgagcatttaggttgattcaatgtctttacaagtgtgaacagtgctgtaattaacatacatgtgcatgtgtcttttataatagaatgatttgtatttatttggatatatacccagtaatgagattactaggtcaaatggtatttctgtttttaggtctttgaggagtcaccagtgtcttccacagtggttgaactaatttacactcccaccaacagtgtataaccattcctttttctccacaacttcaccagcatctgttatttttgactttttaataatagacattctgactggcgtgagatggcatctcattgtggttttgatttgcatttctcaaataatcagtgatgctgagttttttttcatatgattattggctgcatgtacatcttcttttgaaaagtgtctgttcatgtcctttgtccactttctaatgggttttttttcttgtacatttgtttgtatttcttataaatgctagatattagacctttgtcagatgcatagtttgcacaaatttcctcccattctgtaggttgtctgttcactttgttgagagtttcttttgctgtgcagaagatctttagtttaattagatcctgtttgtaaacttttgcttttcttgtaattgcttttggtgtcttcgtcatgaaatctttccctgtttctatggccagaatggtgttgcctaagttggagtttttctagttttgggttttacatttaagtccttaattcatcttgagttaatttttgtatatggcggaaggaaggggtccagtttaagtattctgcttgtggctagccaattatcccagaacaacttactgaatagggaatcctttccccattgcttgtttttgtcatgttgaatatcagatagttgtaggtgtatggccttatttctgggttctccagtctttttgattggtctgttttctctttttgtaccagtactatgctgtttggttactgtagctgtgtagtacagtttgaagtccagtagcatgatgtgtccagctttgttcattttgcttaagattgccttgactatttgggctcattttttgcttccatatgaattttaaaattgttttctctagttctgtgaagaatgtcaatgctagtttaacaggaatagcattgaatctataaaatactttgggcagcatggccattttaacaatatcgattcttcctatccatgagcatggaatgtttttccatttatttgtgttatctctggtttctttgagcagtgttttgtagttctccttgtagagatctttcacctccctggttggctgagtattcttaagtattttattatttttatggcaattgtgagtaggattgcgttgcctattcggctcttggcttcactgttgttgatgtacaggaatgttagtgatttttgtgcatttattttgtaacctgagactttgctgaagttgtttatcagcttaaggagcttttgggctgagactattgggttttatagatataggatcatcttgtctacaaacagggatagtttgacttcctctcttccgattttgatgcccttttcttctttctcttgcctgattgatctggccaggacccaatactgttgaataagagtggtgagagagggcatccttgtcttgtgctggttttcaagggaaatgcttccagcttttacccattcattatggtgttggctgtgggtttgtcatagatggttcttattattttgaggtatattcatttaatacctagtttatcgagagtttttaacatgaagggatgttgaattttatggagagccttttctgcatctattgaaataatcatgttttttgtctttagttctgtttatatgatggctcacattaattgatttgcatgtgttgaaccaaccttgcatcccagggataacaagcctatttgattgtggtagataaattttttgatgtgctgctggatttggtttgtcagtattttgtagttgatattcatccaggctattggcctgaagattccttttgttgttgttgtgtgtctgccaggttttggtatcagcatgatgctggcctcatagaatgagtaagggaggagtcactctacctcaacttttgggaattggttcagaaggaatggtaccagctcatctatgtacatctggtggaattcagctgtgaatccatctggccctgggcttttattggttggtaggctatttgttgattcaatttcggagctcattattgtctgttcagggattcagtttcttcctggttcagtcttgggagggtgtatatgtccagaaatgtatcaatttcttctagattttctagtttatgtgcatagaggtgatcataatattctctgatggttggttgtatttctgtggggtcagtggtaatattccccttgccatttctgattgtgtttattggaatcttctctcttttcttctttattagtttagctagtggtatgtctgttttattaatttttatcaaaaaacagctcctggattcattggtcttttgaatgatttttcatgtctcaattttcttctgctcagctctgattttggttatttcttgtcttctgctagctttgggattgtttgctctagattctctagttctttagttgtgatgttaggttgttaacttgagatctttctaattttttgatgtagtcatttagtgctataaatttccttcttaatactgccttagttgtgtctcagggattatgctacattgtatctttgctctcattagtttcaaagaacttcttgatttctgccttaattaatttttttacctcaaagccatttaggaacaagttattcaattttcatgtaattgtatggttttgagtgaatttcttagtcttgatttctaatttgattgtgctgtggtctgagagattgttatgatttcagttcttttgcatttgctgaggagtgttttatttctgattatgtgatcaattttagagtaagtgccatatggcaatgaaaattgtttttgtgtggagagttctgtagatgtctatcagatccatttgatctaatgctgagttctggtcctgaatatctttgttaattttctctctcactggtctgtctaatattgtcattgggtgttaaagtctcccactattattgtgtgggagtctaagtctctttgaaagtctctaataacttgctttacgaatctgagtgttcctgtgttgggtgtatatctatttaggatagttagatcttcttgttgaattgaaccctttatcatatgtaatgcccttctttgtctttttatctttgttggtttaaagtctgttttgtctgaaactgagattgcaactcttgcttttttctgcttggtagatttttctccatccctttattttgagcctatgtgtgtcattgcataagagatggtctcttgaggacagcatatcaatgagtcttggttttctaatccagcttgccactcagtgtcttttacctggggcacttagcccatttacctttaaggttaatattgatatgtgaggatttgacactgtcaccataatgttaactggttattttgcagacttgtttatgtgattgttttatagtgtgactggtctatgtacctcagtgtgtttttgtagtgctggtaatgctttcctttccatatttagcgtttccttcatgagctgttgtaaggtaggtctggtggtaatgtattccctcagcatttgcttgtttgtaaaagattatttctcctttgcttatgaagcttagttaggctggatataaaattctgggttggaatttcttttctttaagaatgttgaatattgacccccaatctcttttggcttgtagagtttctgctgagaggtctgctgttagtctgatgggcttccctttgtaggtggcctgacctttctctctagctacctttaacatttttcctttcatttcaaccttggagaatctgatgattatgtgcttggggatgatctttagtattagtaaaaagaattttactggggttctctgcattttctgaatttgaatgttgccctctctagctaggttgaggaagttctcatgcatgatgtcctgaaatatgatttccagattggttgcattttccccatctctttcagggacatgaatatgtcatagatttggtctctttacataatcccatatttctcagacattttgttcattcattttcattatttttctctattcttgtctaactgtcttatttcggaaagccagtcgtcaagctctgagattattttcttcacttggtctattctgctattaatacttgtgtttgcattatgaaattcttgtagtgtgtttttcagctctgtcaggttggttactttttaaaatatatatatatactggctgttttgtctgtcagctcctgcattattttatcatgatttggagaggtgatgcagtcatttggaggaatgaaagcacactgactttttgaattttcagggttcttgcactgacttcttctcatctttgtgggtttatctaccttcaatctttgaggttgctgaccttcagattttttttttatcctatttgattatcttgagggcttgattttggtataaggtggattcaactgactagcttcatttctggaagattttagagggccaacattcagctcccaactcctgcactgtgtactctaactctgggggacttctattgggccccagctttgttctttggctccccaaggttaggaatccactgcggtgaaggggcctgaggtgtggcagctgtggcagagtgctagcaggtgtcggggtgcctgcctccatgtgggtgttcaccacagtggcagaaacaatgcagctgttgggggagctcctgctggcaactatatgtatggttgtgctggacatggtgttggcttgggggtggggtgctggcagatgcaggcctgggtgccttctctgtgccccataagcaggagtgattggtcagcatgggggaggactgttgttctctgcaaaaatgtttaaaaaagaaattgtttcaaaaatctatataaagctttggattctgtaaatccaaaattcattactggtttattactttactggccagggattatggcaccagaagagagatctgtggttctgacaataagccatgaatgtggtttgcccagtacatggtttagctttgtttctgtatcagacacgctagtttaatttacaaatggagttttgatatactcaggactgtgaataagtattggggggtggtgtctggtgaaaggcagacaaaccacagtagctcatttccttttattgatccgagcacaaagcattgttgttgcatcttagaaattaaaatcctcatttacagaatagtgtggtgcaatctggaaagatgttgttgtggtctctcaggagtgaataatatgagtttttaaacattttccaagaaaaatttacatgatttcaaacattctaaagcataaggatgtacagtatttcttacagtagaggaaactgccaaatattttggaaaaatataagaaaggaactgtacattggtaagaatgcattttcaaagactatttattttgtttgtttttaactgaacagttattcattgagaggggtgtgtgtgtgtgtgtgtgtgtgtgtgtgtgtgctgaagatagtattatcccaaataatcatattatatagaggctacaactcagtcttgcaaactgctcttacttgcaactgacagctacctcccacaccctcttggcatttctctagtgaagctattgatgtaattattgcttttagggttctgtattaaatttaaaaaacaacttcttttaattttgtgcttaatacagaaatcctaaaaaatcatagaaaaacacaaaggaaaaaaatccagcattaaccactaactaagtggataactaagatcagagaagaaactaaaacaagtaactaataactaagatcagggaagaattgatggtgatagagacgtgaaaaatcctccaaaaaaatcaatgaatccaggagctgttttttttttgaaaaaattaacgaatagatagaccattagctagactaataaggaagaagagggagaagaatcaaatagacacaataaaaaatgataaaggggatatcaccactgaccccacagaaatacaaactgccatcagagaatactataaacaactcgatgcaaataaactagaaaatttagaagaaatggataaattcctggacacatacaccctaccaagactaaaccaggaaaaagccgaatccctgaatagaccaataacaagctctgaaattgaggcagtaattaatagcctaccaaaacaacaacaaaaaaaaaaaaaacaagaaaaaaaacacagaaaaacaaaacaggaccagacagattcacagattcacagctgaattctaccagaaatacaaagaggaactagtcccattccttctgaaactattccaaacagttgaaaaggagggactcctccctaactcattttatgaagccagtgtcatcctgataccaaaactgggaagagacacaacaaaaaaagaaaactacaggccaataagccaaataaacattgatacaaaaaccctccataaaatactggcaaaccaaatccagcagcacataaaaaaaaaacttatccaccacgatcaagttggctttatcgctgggatgcaaggctggttgaacatacgtaaatcaataaacgtaatccatcacataaacagaaccaaagacaaaaaccacatgattatctcaacagatgcagaaaagacctttgataaaattcaacattcttcatgttaaaaactctcaataaactaggtgttgatggaatatatctcaaaataataagagctatttatgacaaacccacagacaatatcatattgaatgggcaaaagctggaagcattccctttgaaaaccagtacaagaccaggatgtcctctctcaccactcctgttcaccatagtattggaagttctggccagagcaatcaggcaagagaaagaaataaaggtattcaaataggaagaaaggaagtgaaattgtctctatttacagatgacaagattttatatttaaaaaccccatcacctcagcccaaaaacttcttgaactgaaaagcaacttcagcaaagtctcaggatacaaaattaatgtgcaaaaatcacaagtattcctttacaccaacaataggcaagcagagagccaaatcatgaatgaactcccatttgcaattgttacaaagagaataaaatacctaggaatacaactaacaagggatgtgaagacctcttcaaggagaactacaaaccactactcaacgaaataagagaggacacaaacgaatggaaaaacattccatcctcgtggataggaagaattaatatcatgaaaatggtcatactgcccaaagtaatttacagattcaatgctattcctatcaaactaccattgatattcttcacataattagaaaaatcgattttaaatttcatgtggaatcaaagaagaccccatatagccaagacaaccctaagcaaaaagaacaaagctggaggcatcatgccacctgacttcaaattatactacaaggctacagtaaccaaaacagcatggtactggtaccaaaacagacatactgactaatggagcagagtagagacctcagaaataacaccacacatctacaaccatctgatctttgacaaacctgataaaaataagcaatgggaaagaatctcctattcagtaaatggtgctgggaaaactggctagccatatgcagaaaactgaagctggaccccttccttacaccttatacaaaaattcactcaagatggattaaatacttaaatgtaaaactcaaaaccataaaaaccctagaagaaaacctaggcagtactattcaggacataggcatgggcaaagacttcatgactaaaatgccaaaagcaattgcaagaaaagccaaaattgacaaatggaatctaattaaactaaagagcttctgcacagcaaaagaaactattatcagagtgaacaggcaacctacagaatggtagaacatttttgcagtttacccatctgacaaaggtctaatatccagaatctacaaggaacttagacatatttacaagaaagaaacaaacaactccatcaaaaagtaggcaaaggatatgaacagacacttttcaaaagaagacatttatgtggccaacaaacatacgaagaaaagctcaacatcactgatcattagagaaatgcaaatcaaaaccacaatgagataccatctcatgccagtcagaatggctattattaaaaagccaggaaacaatagatgctggtgaggctgtggagaaataggaagacttttacactgttggtgggaatgtaaattagttcaaccattgtggaagacagtgtggtgattcctcaatgatctagaaccagaaataccatttgacccagcaatcccattactgggtatatacccagagaaatataaatcattctactacaaagatacatgcacatgtatgtttcctacagcactatttacgatagcaaagacatggaaccaacccaaatgcccgtcaatgatagaatggataaagaaaatgtggtacatatacaccatggaatactatgcagccataaaaagaaatgagattatgtcctttgcaggaacatcatcctcaacaaactaacacaggaacagaaaatcaaataccacatgttctcactcataagtgggagctgaacattgtgaatacgtggacacagagagtggaacaatgtgcactaaggcttgttgtgggatgggggtgagaggagggaacttacaggataggtcaatagttgcagcaaactactatggcacacgtatacctaggtaacaaacctgcacattctgcacatgtatctcattgttttttttttttagaagaaataaaaaaatttcagtgttaatgactgtttacattttcgtgaattctttccaatatttgatatttatacatatataataaaattatatctacctacctatctgtctacctatctatctgctttctagtctccctttttcttttacttagctcagatcatgaagatttttttccatgtcaataaatatatttcttctcttttctttttcttttcttttttttttttcttttttttgagatggagtctctctctgttgcccaggctggagtgcagtggtgcagtctcagctcactgcaacctccacctcctgggttcaagcgattctcctgcctcagcctcccaagtagctgggatcacaggtgcccgccaccatacctggctaattttttgtatttttagtagatacaaggtttctccatgttggccaggctagtcttgaacacctgacctcaagtgatccatctgcctcagccttccaaagtgctgggattacaggcatgaccaactgcactcagcccaataaatatgttctataatacgctacttaatgatacctattacattatattgtatggaagttccattacttacttaatctgttcttcctggacatctgatttttctttattgtaaaatgtgacatcttaaacatctttacatattcatcttcttccacgtctttgattacatcctttgtatagctcttagtagtgtttttgctgggtcaatgtttttgtaaataaaaaaaaaatgttaaagactttagacatgtataaccaaagtgccccagcaagagattgtaatccgcttacactgcctccaggagttttttgggagtacttgttttttcctaccctctcccaccagataatatgattctttttaccatttttaacccattggataggaatatattttcatgtttttatttgcatttctttggatttttgaggctacgtattacaaagctgttattttaaggcataccagagaacatgaaatcttattttatccatattttggttttatccatttgctttgaaccccctgaatcagctgccctgatggatagtttttttttttttggtgtgggcttggccatgatggggaacttggttgaaagatgagtgaagttaaggcagttcaaggatgtcatactttttagaagtaccagacaatcagaaaaaagtacagaataggagaaacaaagaaatcaaatacttaaaaaatatattcccccaggtcaatgctttgccatgaaaaggagaaaaaacagttctttctctctaagctgcagtaccccttggtcactgttccaaagcttggggcagaccatttgtcctatactatggctacatgtggatgaagtcatttttgtgtggtcttttaagactgaaggtactaatcacaattttaacattgcttctccagaaaaatactttctgagttacgaactttggggacacaaacctattggtcatttggagatctagtttcccttttatttttctaaattaaacattaaacaagacaatctgagctttgcctttttttcttttgggtaacttgatttcccaattataaataatgattatttaatgtctgttaattctttcacagtttagggtgaattctaattagccatctccctaagatatgtggtttgtggcttgaaaagttttctaatgccttccctccctagaactaatgactcagaactgagaaagactgacacagagcttcatcttctgctggggctgcaaatgctctggagattgcccacgccctcttgcagccactgctagatgaagatgaaagcccactgcccagacggcatcagtatttcacctgctcagtattgcacagaaaagtcttggtttgacttacagcctgctcattgctggaaggtcacagcactgttttttgatggagttttgagtagtcattttttctagtgctttaaacagattaaaatgtggttttatgggtagtcatttcctagatgcttgtgaaaacaattctaatcctaattgatggtagaaactgattcggagactcagtaaagaaagacatctgtgacgttcagttcaaaatagttaattattgattgatcacccaccagcattagcttatagatacacctgaggattaaacatgactttctggaacaaaataacttttttttttcctaaacataatgtacaagctgagcttaaatgagtgaaattataaaaggagataatctcaattttgccctatataagaataaaatatcagtcaaaatatttaaagaacagagatttctgtttggtgcaattttctggttaagaggttaatggaggggaatggaaagttattgttttatggatgcagaattttagttttataaaagagttctggaggtagatggtggtaatgattgcataacaatgtgaatatatttaataccatttagctgcacatttaaaactggttaatgcctggtgcagtggcttgagcctgaaatcccagctcctcaggaggctgtggtgggagaatcacttgagcccaggagttcgagacaacagtgagctctgattgtgctactgaactctagcttaggcaacagagtaagacgttgtctattaacaaaaagtaagaagaaaagaaggttaagatagtaatttttatgttatgtgtattttactacaatttttttttaaaaaagagttaaattggaaacaaaagtcttttaagagccttttggtctgagctttgacttaataaatacaatattaaatgaaattgtgcatttactaaatatttgagggacattattctggaagccaggtctcattttctaggactggagaagacagaatgtgttttggactcaggatgtgtttgtgaaagagcttaaaatttctttaggtgattgtgcattcctgtgatatgcattttctccaaaatgtacagaaagaaaaataatttgaaccctaattaattgggttctaattggtctgtgttttaggctctaaaggatcttagatcctttagatctttattaaatactggtaattcagtatttaattgtaactgatttttatgcaactgcgcaggagaagaagtgttcaggtgcagctttcttcccatccgtgccttccctaggccattgtgctttgtgttcttaagactcggtgaatgtttctgaaggtcagctagagtgcagaggagaattaatattaaaatgcatttaataaataagctgtcagatgattcccgaagataccataagcagcagaaagtcttctttcctctttcattcagatcgctgtgtacagagggaatgatggttaatatagtctctgttggcatctcctaacgggctttggtaatcatttctagcccagccgtgctccacggatttcatcactcttgagtgacggggccattttctcacagaatatggaccctccctgaaaaagagggagcagaaatagtcatctagcagtgtaacagttagggaatagaaagaaaatgacggattttgcagagaaggtctgcagaaactgatccagcatccctggcagtttgagtagagaatgggattttggtctttactttgaattgtcataattatttaatgtcaaacctatggagtgttatgaggctgtaagattttgaactctgtgcccttcagaggctctgcctcaggacacaaacacaggaagattaaacattaattaaagtaaccacacaggagaataaacaatgtaaagaagtagaaaaagacctggcttccccaccagggtaagccattttagaaagagagattttgtattgaacttacgagatggatgaaataggcttcactagacccaagggcatggagtaatttctcaggaaagtattctgccattgattcctggaagaaaaattagaaaaactcagtggatgatggaccaacccagaggccctaatggtacagagagaaaggaaacatgaccatgttcaagttacaagttgtagctgaccttgatgtttatcgccagaccgtgggaggttttggaatctgactgatgtctttcttccctgtagattgttattcagtgcctcggatgtgggcctaggaacctgtatttttaaaagattatctgatgtacagccgggtatgaaaactactgatcaagatcaatagttttaattaaagtcagggtggagggagtaggagggagggaaagacagagggagaaagagggacaatgaatgagctttggattcctttgttcaaatatgatcatctgagaaagagaaattctgaactgtcagtcggttcagagcagagctctgctggctgaattggatgtgggagatttttcttaggttcccagggccacagaaaggaagcccatgctgaataatccagatttaagccttacccattggccttggatgcctatttctgtcttccttgtctactactgtcactgtcaaccccttgtggctgttccatccccatgtgtcagctctttgtgggctggtttgcccccggaactattgctctgagttcttctgtccattccctgctcggctcagtgggctcctgagttagcctttagcatgtcacctttctggcatctccatggtaccagaacctttacttttcacgtgggctccaaccagcagcagctcccaactaggagtgtcccagcctggtggaaaggactggacacacaagatgggtcggaattgaatattaaatgaatttcaatacttggtgtacctttgtgaagtagcacattgattttgagagagcattgactttaaatctgatagatttttttgcaagcttcttttcagcaaatggcttactgtccttccatttgctgaggtcaaactccttggagtcattcttaattcctttctgtttttcacaccccatgttaaaatagtgaatcccttaacatatgtaaagaagccatctctttcccccacctccattgtcaacatctgggtctgtgtcaccaccatgtgtggcctggattattgccacagtctactaatttgtctaccagtttctgcccttgttccttgagtcttttcctaacatagtcatgtaatgatcctttaaagatatgactcaggttcctcccttttactcagaactcctgtctcttagagtgaaaaccaaagactttatagtgtcctacaaaaccctccatgacatggtgtttcccatcaggatctaccttgatcttagccaaaagcccaagaagcgatcttatcctgatctcacctcatctccaacttatttgcccttcagtcactctgctctggccataatttcctcctttactcacttggccaagcatgctgctgcctctgggcccctccctcatttcctctggctgaaagatgtttttgtaagttaggtatttgtatggttccctcacttttcttcaagtctgaccaattttgccttattagagtcagtttcagacctgcctatattaaaatggaacccctttgttaatttcatatactgttttccccttaccatgctttacttttcttcactgcacatttcatcatctgacattccactaatttattttattggtttattatttataaagtgctaacaaatactttaatccaaactctttgggggcagggcccacattttgtttactgcagatccccagtgtttaaaaagaacctagcacatactaggtgttcagaaagtatttcttaaacaaatgtattattagtaaatctgagttttaaatatagttttgtcacttcttaattatgtgacactcagtaagttacttctcagattcaagttttctaatgttaaaaataaaggtaacttccgtttcatggagttgtttttcagagtagaactaacgtttaatcttcccaactaaagtgtgagatcaaatttgcactaaaaatatgttattattattgctgttgatgccgacgggagacagggaaatactgggtggaagagggcggttcccttacaaaggctccaccctcaagcctggatatccctgtccccaagtgagaacagacattcctgttttcatgcacaaaatgttgccttttagcccaccatgccccctatcctatacccatataaaccctgaaccccagactccagaagcagatgaggagacgaacagatgagaagacgagcagatgagcagacaaatggcagaatgttgcagcagagaaggagagaagagaaagagcgcctgaatgtcagcaggagtttgtctggagatggtcagaaaatcaggtgctggatggccaaactccaggggaagatcatcttcccattccatctcctgtctagctccccatccatcctgctcagagccacctccaccacccagtaaaaccccacatgcaccatccttcaagtctgtgtgtgacccggttcttccaggatgctggacaagagctcaggatatgaaaggtgtcacgctggccctctgcccttgcaaaaaggcagagggtccactgagccagttgacacttaagccatgcgtggatggcaaggctaaaagaacacactgtaacatacacccaactgggctccgggagtcacaggctcccatccctggacgctgctgtggggccagagcccagcatcccaacccctgcacctgtccgtctgcatgctcccactcctgtaaggggtttgagcgatggtggtgactgaacagacaagccaaacccctgttgcaggtcctgtgagagtcagggaacccccctgtttcaccgttgttaatattgatagagctttaagactgaatttattcagacatggatagaatttcaatggaagtggaatccaggaactggctttaatcctgtgtgacttttctagaaagaaagtcttgattgcctctattttacttctaaaaaagtgtaggctacctgctaatggctcccagatttctgcttgaatgatctttgaataagtaaagacgttttggatgtaaattttcccattgttcttaagcaagtcattaaaattaaatataactatgaatggagagtgttttattctttcaattacatagggtttgtgaagagtcattctttgtctacttatatttaatcaacatgcaatattttatgtgccttattaccatgtgttaagaaggtaatattcacgttacctagctattttttacattagccaaaaaaatatggttatgtgcaaatattgtgaagaacatgcatgcaagtagtttgcttattaaccaggtttggtgtcagccacacacttataaagctaataattgctagctattaatattataactttagttcaaatattactgatgtctgttcttctaagactgaatgttaagattagaatttagaatttagtacaagtatgtataaatcatttcaacagaaaaaaatgaatgcaaatcaggaaccagctggaggcagatttgcatgattattttaatgctgtgacaggacgtgaacactcagaaattcgaattaggatgcttatttctcatatctacaatgagcactgagtctctcttatgatgtggccagctatcaccctgtgttatcagcaaaccctactaatagaaatttgagagtctaatatcaaacttactcttcctatttgttttctctgagccctgggttagaagactgatatgaaataagcatttttactatactgagctatacttatcatttacattattggtgttgcttagaaattactccacaggttttcaaaagataaatcatgccatttgattatcagcaaccatttgtccaatcagcacccaaatgcagtgtactctttgcactgggcagccactcttaagagagatttaagaagtaacaaggccatttttgtggataagtctagacaatagtcttttctgtagcatgaaactaatatctggtcttattgcatgatcatttttcttgcacctgctaaatcctttagtgccattcataaaacttttcataagaatgacttcatagaagtttctattctttttagagatatgattacctatctgctttcagtttacactattgcacttgtgtgtgtgttgtggggggtatcctctggtcttgtgcaattattttcattttagttactcaaatgaattgctgattaaaaagtaaattttgatggccatgtaaattggagatgattctggcttaaagggataactaggcaggtatttttgaaaattaataagcaaggctatcactccacataaacaaagcgattttttaaggaacagaacacttgatatactggttgatgcttcagtctggtgtggtatttgaagagcataaagtcgtaacatagattttcattttaatgggagtgttgtaataccttcataattttttttttttacttctcattagtttttacaacctacgaattacctaaaacaactttagtcatttgaattttgacttgccacttattttactatgtgcaaaattgtcccatttgagaaatggaatctgtatgtatggtattggtgtctatggctagacattaggactattacagagtttgcagatgtcactatgtctaatgcagttctaatgcagatctgtttggggttttgtttaatatatggttatggagaagtctagaaaggaatgacaatgaagtagtagttactgtaaatcttgtggtcacgtaatgaaaatttaggagacttttctgtacaccactttagctctgctctttgtagattgactcatctagaggagattttgtacaaatttttttcagctaatttctccagttcatttgtttattgatatagtattacattattatttagttaagcaaatggtctacaccacatgacttcaagcctcaatgtcttcttttttgttgttgatttgtatactaaatttcagaaatggctttttatggggaaggttggagacaaataatgactatatacacatatatttcacatatatatgttattgaaacatatgagtgtcatatatgtgtaagtggatgtagacaagtaatgagtatatatacatatacagtcatgtgtcacttaataacagggatacattctgaaatgcatcattaggtgattatgttattgtgggaacatcaaaaagtgtacttacacaaccctaggtagtagagcctactacatcatacctaggctatatgttatagcctatgacccctaggctacaaacctgtacaacatgctactgtactggatactataggcaattgtgacacaatggtaagtatttgtgtatctaaacatatttgaacctagaacaggtacagtaaaattatggtattatagtcttatgggatcagcattgtatatgcattctgttgttgaccaaaatgtagtgcatgaatatatatatatatatatatatgtatgttactgaatatgttatatatttgttattgaaacctacttttattattatatatatacatatacataaatacatagccccacttcttcagtcatgtgaagttacgcctactgatacgtgtattagtctatcttgtttcttcttgccacttttctctctactctgagcccattcacgtaacccattttaacaattacttatagattatttcataatttccttattttagttcatttctaatcattaactgtgttattgattaccccttatgtgaaccaaaaacatctccataggggcatttctttgagaggatcagttctgctttattaaaggtaagtcagcttatccaagtcaccagaactgagttaagaaacatatggggctgggtgcagtggctcacgcctgtaatcccagcactttgggaggccaaagcaggaggatcatttgaggtcaggagttcaagaccagcctggccaacatagtgaaaccctgtctctactgaaattacaaaaattagccgggtgtggtggcgcatgtctgtagtcacagccacttgggaggccgaggcaggagaattgcttgaacccaggaggtggaggttgcagtgagccaagatcgtgccactgcattccctcctgggcagcacacacacacacacacacacacacacacacacacacacacacgaaacatatgggcaatccaggggattctagctcttcagagtttgcccgggactaaaaatggcagtacaaaattgagcattggccctttgagatcactgggagcaaaccaaccaatgaggaccacccatgggaacagatggagttcagaactggactttaaatcggggctcactctacagagggtattgtggctggacagaggatgctcattgcatgaaaaggaatctgtttgtctgggtcagtggggaagagttctggtgtgtcagactgtcttattttgagttaaaagttttacaggtaaagatttgctttaattttctactcatgttgtccagtcgagtatggccatgtgtgcttctgtctctgatgagaaataataatgataaagatcatgagagcagcaggtaccactctgacaacgaagtgcccttctctgtcctagttattttaaaggtagcacattttttttaatcctcgcacaaccctgtgaatccatattgctttcttccttttacagataaggaaactgaggatcagagaggaaaaccaacttgctcaaggccaccaggctagttagtgttagacccgagactcaaatctaggactgcaggacttcctatcccaggtcaacgttatctagtgcttctcgacattttgagatcagtttaaatactccttattgtgcttttcttgtggatctgcaggcactgggtctggcactgaggaatcagcgatgaccaagacttggtccctgcttggagaggttcacaacacatgcaccattttattggaacatcacattacattatgtttaatgtgacataatacgagctccagatgaggagaccttttctttattttgttcttaaaacagtgcctggaacatagtcagcactcaatgaacatctggaaaacataaaatatgtcacgaaatcctgtcatggaggaaagcactctttgctttgtctgtggtttcatctgtgcctcactctgaattttactctgggctcctcacccctgatgcatttgcccacgacctcctggcatgccttgctgcccttagcattcattctgcagaaactttatggagcacatactgtgttctgtgcatatactgccagcattgtgctggcattagggacacagagacgaacagaccagacatggtccctgccctcttggaggaacacaactgctctgtacccatgggttctgcatccatggattcaactaaccttggatcgaaagtactcagggaaaaaaatatatgtctgtactgaatacatacagaccatttttccttgtcattaagtctgaaacaatacagtataacaagtatttagcatttatatcgtgttaggtattataagtaatctagagatgatttaaagtatacaggaatatgtgtgtaggttatatgcaaatactatgccattttataacagggacttgagcatctgcagatttttgtagttttgggaggtcctggtaccaatcctccacagatatggagggaccactgttctcttatacccagttctccttcatggttcagaatttagctcagctcttcacccacacacattacactcttccacccactgccccatgtcattaataggattgattcttaagtgtgtgaatggcagtcagagcccatgcacctcaactctgacttgaccagatgccacaccctggagtttctccataaagacctcctgccgtggattctcatccacttctttgagcatatggaatgtccatggtggaaagaagcagacaggtctaaataaacccattgactactgagaaaagaattaacgtgtatgagacccccgactatgtctcaggcaatattctagggcttttcctccttcattccattctcatagtaatcctgagggaaaaaaaaagcagtattttctttgtttttctggatgaggtccactgaggttagtggggtgtccaagcttggagagctagggagtagtagacagccgagataaggaatgcaggtccgtctttgtacaaacctgcttatctccatacaaacctgccatgtattctcaaggttatgagagaaccagggagggctggagactgagctgcctggtggtgcctatttatattcatgctctggaaattgtacatgtaactcattactgtggtcatctgctttctgcagcctcgtgaggggcccttctcatgttcctctgtagatttatgagcttgtacatggcacctccattctacggcagtttttagagttccctgaggattcttataacaatcacaattatttaggttctaaattacccttgtccagtgttaagcagatgagcagtgttttcaccttctaaacaatgattcctgaggcaactgctgccataatatcacatttcgtttccaaggaaactgcatatccatcccttcctcccacccttcccacttccttaagcatgagattttttaaaactcaaaatgtgccatttcaacctcttgttactgtgaaagttttagttccggcattggttcctaggaaattacagttttccttctgatcttcttcttaatgtgttggatgcttttctgcagaaagctgtgcattctaaatggcattgaaataaattactgccttcattatgacacacaatagatgaatgtattctacttcagagtcacagcttctttagccaaaataccttggttgttttccatcctgaagttctataattgcttacttgatattccattgtgagatctcagaataaagtaaaggtaggctgtggtatatatgtgtcttttactctcaggctgtacgtgcattcaagttacctgactggatggattcagtaagtttgtaccctccagataaagtaattactgaaactaagcatccattttctatagattatgttactagtgactaaaaaatatctccagatattgtataaatcatggaattcaggcagctatgtttactacaagtggcagtgaagcatttacttactccaaaggaactctggagtactttgcaatcctgctggaaggcaggggagatgtgggtggccacacagagtcagaggatgtcaacatgcagacatctgtgtaggcatctgagttatgctgatcgaagactctcttctcactctttagtttccccactccaaacacacacacacacgcacacacacacaaacacacacaacctcagaaaaccgtggtgagcagccctgtgtctacagatacccactcctggcaatgtccatgtagctaacttccggtcaccatgtccgtcccaggattgccttgagcctctatacctccctccagcctccaggcttttgatatagagacctagacatttggattttgtttttgtttttttccagaaaatctctctgagactcaacgcttaggtaatgtggaactcagaacctgactattttttttcaaagaaaggagcagtcatgaacagcctatgaatagatataagtagatgcagaaataatctgtatgggccaggcgcggtggctcacgcctgtaagcccagcactttgggaggccgaggtgggtggatcacgaggtcaggagttcgagaccagcctggctaacatggtgaaaccccatctctactaaaaatacaaaaattagctggttgtggtggcgggtgcctgtaatcccagttactcaggaggttgaggcaggggaattgcttgaacccggaaggcggaggttgcagtgagctgagatcacaccactgcactccagcctggatgacagagcaagactccatctcaaaaaaaaacatctgtatgtatttagtaggtaagggtgaaaatgattattatagtgtgtgtgggagtgggaggaaattagcccatgtactattggactggtgatgtttctaagggattgttgtatatgcgaaattgatcttccatttacctactcttttaagcacttgggcctggtcagttgacaaggtaaagttgacccttgaacaatatgggagttaggggcactgatccctatacagtggaaaatttgtgtttaacttttgactctcccccaaaacctaactataatagactactactgactggaagctttaccagtaacataaacaattgattaatacataaaaatgttattaagaaaaccataaagaaaataaaatgaattcattattcattaactgccagtggatcatgataaaggtcttcatcctcattgtcttcatgtagaggatgaggaaccagaagaggacaattggtcttgctgtctcagggttgtcagaggtggaagaaaatccacatattagtgggcctgcacacttcaatcccatgctgctcaagggtccaaaggaactttggagtactttgtaatcctgctggaaggcatgggagatgtgggtggccacacagggtcagaggatgtcaacatggagacccctgcataggcatttgaattatgctgtactagcttctggtgggcagcaggcctggagccagtctctctggtagagttggatggggccaagagggtataagtcttactccttcttcccataggagaatggaaagggagcttccttaagggatcctggccctgcagggctgtatggtctcacaggcaagggtgcctatctgctgggagaaaatgctttgtgtgctcatattcatgcaagtaagttcttagattattgtcttacataaagtgatttgtaccctttgcctatggttaccaccaccacccctgtgataagtccatagcttcccaaactccaggcacatagaacctttctgccttttttggatccacctctgtatgcagtggctctggacttcttggtgtccccacattggtctgggctgaacctgacaggccaatagacaagggagtgaactatggatgtactcaagttcattaagtcacacgtcattgtgcttagtgaatgtggcaatctgagacaaatacgccctttgatgaatagagagtagaatgactaataagagatcagaagccagcaaagagtaaatccaataacaacaacaagaatgtagagtttgaaatttcttaagtttaaatgagaatgttagcttattttgcaaatagctttgtctttttctgacccctcctcccaccatgtggaggtatggaggagagaaaggctcttgcagaaaagtataagcggtgcaagtggagagtgctgcagagatggagatggaggccaggtctgctggtgaagggtcttatagtccaggctaagatgttaagcataccttagaggcatgaaagaatctctgagggccattaagtggggaccgaaattctaaaagctcaattcttagcctggttgggggatcaatttctagttattggatcacagtggactgaattctgagagctcagtgtgacagataaaggaaagtttgtcagatggatactgttttctttataagaatcttctgacttttggggtagagtttaacccctcattttaaagcaactcattatgtctcgttggtatttaatgaaacgaaaataatgtagtatgtgacactcatgacatttcacctgtaaagtaatttatggtaatttgtcctagagtgttctatcataggttgataggattcaaggactatatacttgttttctaccctaatagataggagggtggagtaggatgagaggcaggctcagagataggaagaaaggattttttcatagcaatgcaaaactgttagaaaagtgcatggtactccaacctttcagcctagtgacttcttgctgccgtggagtggctgcagtttccttctttgcaagtttggagcatacgcccagatgctggaaggatttggtttacattatattgaaaaataaaacaagacaagtcaagtaaaacaaaacattagcaaataaaacccataagcaaacacaaataaaatgatttagtgaggtaatttctcacaaatttcagaatttcccacaatcgtacagaaatggttcttgcctgtggctcacatgggcttcaagaatttaatttacccgtgttgatcagatgtgtaaaataatggttccatcattggttgcaaaaacttcaggtgttggattttggaagtatttacttacagaggtctcatcattgtaaggtaaagctttttagccatccaggccaaatggtgggattgagattccatctgccattgttcttacggacatctaaaaagagcaagaaaggggtttttatatttatttgatatttatactcccatccccagaagcccatttaaaaattggtattggttctggtagcagaaaaagtggaagtgaaattagagtatagaaacttatttctcaaagtgtggtctgcagactggccacatcagcatcacttgggagcttgttaaaaattcagagttgctggccccacaccatctcactgaaccagaaactgcattttaccatgatcctcagataatctgtctgcacattaatgtttgagaaccactgaatggggaatacctttttaggaagcatggtcatgaagaaagtggagtggttgtggagaaggtcctagctagagatggagcatgaggtcagggcatttgtttgtcttaaaaaaatttagacaagccttgagcatgtttatacttgtggagaaggagacctttgaagtaaccagacaccaaaagacaaataccatatgatctcactcttacgtggattctaaaaaaaaaaaagaattgatatcatagaaacaaaccgagtagaaccacagttactaggatactaggaattggggaggtatgggaggcgaggaggatggggagaggatggtcaacaggtacaaagttacaattaggaagactgcgttccggtgttctattgtacagaagggtgacagtggttaacagttaagatgtgatatattataaaatagctagaagataggcttttgagaatgtcctcaccatgtataaatgataaatacatgaggtgatggtcatgctaaataccatgatttgaccattatacaacatatatatgtatcaaaacatcaattgtaccccataaatatgtaaaattacaatgtgtcaactaaaaaataagaaaagaagttgaagagaaagaagaggtggctgaggtccctggggagctagagggctgagatgtggtcataggagggaaagtagactaaagtggatgaatgacacttgttctcctgaaatgagagggaaggaagagcgggtaggctgcatgtaaattagcttgtgtattgaggaaactggaaaattgagagtagtaaaaaatggtgacttatttttaccgatgatggaggtggagtcactttttgagcataaaggggcagacctggtcatgggatttcagaaaagttcagggccccttagaaaaacacactgatgggtatgggaaagaacaggtgggggtaagggggcctgagttataggttgctttggtctcccccttgtacaattcaaaacacctttcagatatgtagaatggaagaagtacccaacattgatgtatattaaattccagccctgaacatcatataattaaagaaactaatataatactgatataaaatgtgggactgttttgactgtattggtactttctttttcccaaaaaggcagagctgcttttgcatatgaactcattttcttcaaaatccattatcctcatgtgagagatgtagaattttgggcacagaaaacatgacaaattttgcctgtagtcctgaactgagattggtaccaggctctgctggcttccagctatttcatttcatgatttatcaagagctgctctctagtcgacttggaaaaagagtttttgaagagtcctgctctcacaggacatctgtgagaatgccgaaggagaaggtaaagagaggcacgcttcaatattttattatctcaacccacagccttaaaggtctcctcgattgtctctgcctacaggaaggctcagctgctttttatcattccgttggggccttgtttcaggggcttgtgttttggtaagaagatgttttgtttctgaggacagctggttaaaatgcactgccttaactggaatattcacaggtatgttcttctcggcactgtgaatcatttttcaaagcttttcatggcttctgctctttgatcaggataaatcatgccacagtgagactggaatccactttcatagactcccaggtgtccttgttctcacccactggtctttacttctctgaagagcctgaccttatgaattaaattctttccgattgtaacattagtcagaggaattggggaactggggacttttgtttattaatccttttatcttctgcttttttgcccagaaaggtcatttttcaatttccccagaaggtaattctacttctcttagtaattctcaacaaatgctaagcttaggacatttatataaaagccagaataaacattaagtttagaagtgtcatataaaaactagaaacaagcttttgtgcttctgagtataacttaaattaggtagaaaaaatatctaataataaaagtagattcttctaccctgtgtagggtccacaaaggaaaaaatatggcctcttctttttaggagtctagatcccactttctcaaagtgccttccttcatgtgtagccaccccacttccagtctacattggggacccccaccattagaaaatgtctttatttatttatttttaattgtcaaaagattgtatatatttgtcacacacatgttgttttgaagtgtgtacattgtggaatggctaaattgagctaattaccataagtaccaactcacattaagcctcccttctttatcttctcttagcgtccttgatttcctccacaacatttaacataactacggtatatttatttgaataaatattggtttaactgcttcctccctgccaccccagactctgagtcccatgatggcaaaagccttggtagctgtagtagatactacatatatctttgtggaatgaataataataatactagtggagaatatttgttgtgcttatgatgcaccagggactgggctaactgtgttactcatcctatcttactgatcctctgtcttagcctgcttaagttgccataacaaaataccatagactaggtggcttaaacaacagaaatgtgttttcttgcagttctggaggctagaagttcaatatcaagggtccagtgatttgatttctagtgaggactttcttcatggcctccttcttactgtatcctcacgtggtagagagagagtgaacaggttatctggtgtctcttcttacaagaaccttaatcttataggaccaggtccccacacttctgacttcatttaattttaattactttcttactcctaatatagccacactggaggtcaggactcccatagatacattttgagggaacacatagcaatccataaaacccacctaaccaccctaatgaagtaggcactatgatcatctctgttatacagatgagaccctaaggcttagaccagggagctttctcaaggtcacatgagtaagtgaacaagctggggcaaggttgtaggtcttatttactcaaatctgggttcataaagatataaagatctgaactggttacatatactttctgtttggaagaaatgtaatctgagatatagagtacgagcttaaaggactattatatatgcaaggaagaaagtttataggctaaaagagtggttctcaaaccttgcgttttaggacccttctacattcttaagaaaagtattaaggatctcaaaaagcttttgtttatgtaagttgtatctgttgatatttatagatagcattagaaattaaaactagaaatatttttaaatatttaatttatttcaaagtaataataaacccattacatgttaatacaaataatatatatttatgaaaaataattatatttcccaaaataaaaaatttaagacatttaagacattttttgcaactctgtctcaggtctgtcttaagagaagacatagatatggattctcacatctgcttctggatttactctgttgcaatatgttgtattggtaaaagtagatgaaaattcagcctcacacaaatgttattggaaaaaggaggagtatttgatcagccttttcagataattgtggacattctgttttgttactacagcaaaactccaattggtagttttctaaaggttagttgcgatgtgaaatctgaaacggaatcaatgaacttttcatattctgttactttgaaatccactggtctagcttgcactttgaatggatttttcactcatgcatgattttgtaacatcttgcattggtcatttgaaaatatcagttcactgagttaatacagatctttgagatgttgacacatttcattatacaatatccaaaaatcacattccttaatattaccactcaaatatctcatcagaaaaggctttatgtactgggaagctttcaagcccatgatggcagatgtgagttttacaaaatccgaatttttgcttgaaaacaaggtttttatcattggcatcaatgactattagttgtttttcttaaagtgttaagattatttcattcatttagaagaaaacatctgccaactgcccacatataaataactttacttggttaattttcctttcaggaaaaaattatgttcatgaaaaaagcaattatttgagtttgcaactcaaacaattgcacaagtgcttttccttgtgacaaccactgtatttacgtgtgtagtagaagtgctttatacattttcccatttcatcacacagaatattaaaaagaatgtgtactcaaggtttaataaaattaataattcttacttctccttcaaggacattcttaattgaaactagtatttattttattgagagtacctggctgtgaagagtacatggctgtgaagaacacatggctactagcacagtttggagccactgccttaatttgtgctaaggcgctagcaattttactgaccattgcttttgtatatttggtgcaaatgtcaacatggttaaaaaaataaaaggcaaatacactttagtattctcacaaagacagttttgaccttgtggttccctagtaaggtcttagggagctcctaacatcccctactccccaacattcctccaggatcaagggcttcttccatgagcatgagttctataaaggaagtcaggaacaagcatgggcttggttggactgtacagttcaagaattagggaatttgaaggagtatgggtgaggaatagggaagccattaactgaggttggtaagaaggagaaaggtttttgcaaggagtcttagagctcagaagctcagattatgaggtgatttctctttaaggaaaatcaggagtttctgtaatttgttgagacaaaaatgacactgtccatgtgtttccttatctgtaaagtgggaatataagagtattattattgtgtgaattaatgtataaacagcttagaacagagcttggcacacagtaggtcctatataagtgttattattgtgaaaatggagttttgctctagttatatgatgaattggagcagctgttcttacacttcagtcagcagcagaatgccttggtgggattgttaaaatacggattgctgggccttgcttctggaatttctgactaaggaagtcggagatggggccatgattttgcatttttatcaggttcctgggtgatactgatgctgctcctctgggtagcacactataagaaactgaatcacaggaattcacacaatgaatactataaatatcaatagatacaactcatataagcaaaagctgtttgagattctcaatacttttttttttttttgagacggagtttcactcttgtcacccaggctggagtgcaatggcgcgatctcggctcactgcagcctcctcctcccgggttcaagcgattctcccacgtcagcctctcgagtagctgggattacaggcttgtgccaccatgcccggctaatttttgtatttttagtagagatggtgtttcaccatgttggccaggctggtctcgaactcctgaccttaggtgatccgcccacctcggcctcccaaagtgctattacaggtgtgagccactgtacctggcctctcaatactttttttaaagagtgtaaagggattctaagatgcaaggtttgatgcccttttctttcctagctactcaacaagccaatgcctcttattcatatccatgtatggaaagtgatgtctacttattctttcacttgttttcatttaactttgctcaagaactgaagtttaccccgtgtttttatttttatctgaacaataagctgggactgtaactggttcagtatttatattttttctagcatgtcctattttgctgtgcctaattgctattaaagccagatggctgggttccaaaaacttgtctgatttgccaacagttttactcacctgaacaattttcactggctctaagctccctgacttatatcacaggccatcattgccacttttctgaacttgccagaggtcttagaaatgtagactagttgttaagattgctgatgaagatgtgctaaatgaagagtgttggtagtttgatgattaccaatgatgttgattttaaatcctacattcacttaacaaatatgtgtgtgccaactgtatgcaaggctttgtgctgaatgctgggaaccaaaccgaggaaaaaatatgcatggactctgattgtcagtctgggagacactaaatcaacaggcaattataaaacagtacaatgtcacaatgtcaagggaagggcaggaagataattgggctgaaggggggatctaatccatggggggcagggaaggctttctagggtaagtgatgcctgagctgaaaacttagaggaggctttgaattcgttaggtaaagaaagcaggcaaaaagcatgacagtatcccaggctaaaagggacagagtgtggtaagacctagaggagaagcagcacacaccactgtctttgagaagaagtttaatttggctggttcactgagtgtaggtcaagatggggatgtagaaggtaggaaatgacaagagggtagaaagattaggcaggaccctctaagcctttggggtttctcagccttagcactatcaacattttgggctggataattctttgttgatgtggggtgggggactgttctatgcattataggatgtttagtagcatctctagcctttgtcctaaataccaagagtgactcccatccctccagttttgacaactaaaatggtctccagatatttcaggtatttccaaatgtaccttgtggaagtaaaattgcccctggttgaaaacaactgttacagagttttgcctttatttatgtttttgttgttgctgttatttgtttgtttgttctgagacagggtctcactgtgtcacctaggctggagtgcactggcacaatcagggctcactgcagccttgacttcccaggctcaagtgatcctcccacttcagcccccaagtagctgggactataggcatgtgccaccacacccagctaattaaaaaaaattagtagatatgaagtcttgctatgcttcccaggctggtctcaaacgcttgagctcaagtgatcctcctgcctctgtttcccaaagtgctgggattacaggtgtgagccaccatacctggctttgtctttatgttgagaacagtggtgggcaattataagattttattcaggggattgacctaaccagatttataccttttggacattcatttatagtaacagtatggaaaatgaacagagggttggcagcatttgaggcagggaaacaggatgtcactgttgcagcttggatgtatctaaagaagtggctgtaggaatggagacaactatgtacacttaagatataattaggagatagatttaacagggtttggtggctaattggacatgaatggtggaggagagagaggaatcaagtctgcctcaaggtttctggccttggtcctgaagaagatagtggtgcttttcactgatgaagggagcacaagaggagggacatacttacttggaaagtcaggagaggattgctggtattttagatatgtcggatttgaggtgccttgtgacagccaagtggagattttcatctgtaggtagagttcggtttctggaacttaggagacagaactgagccaatcagcaactagagggtagttgaaactctgggcaaggctaattaagaaaggctccactgaatgggaaggcctggggactaagagccggtcctgggtgacaccaggtagatcatggcaagaggtggaggggctggtgaagaggagatttcagaggaggaaatctaggatgtggcagtgtcagacaagttcagaagagttagctctgtgaagagaagcaaagtttccatccatggctcaaattcttccctttccttcaacaaattcaagtttcatgtggttctagatgctcattagggttcttctgaaacgattggatcctccaagacatagaaggttatgactggttataaaaattgccacatttacctctggtataacccaaatagaagctctgcatcataaaatttagagttgaagacagatgctgtaacttaaaaggattgatgctgggccagactgctgaattctgtagaggctttataatggagacacatctttctaggcagatatcacttgtcacttccataaggaaaattccctggagttgatgagtagtagagctgtgcttctgctttataaaatccacttttgatgaaaaattaacattttaattcagaggtgtgtagctatcaccaaagggttatgatgtcatgtaactaagtctcagataccaacattgttcaatattgtataattttttccagagtggtatgtgctccagataactgacctttgaaggtagtaatgtattatttacatgaaactaaaatccagtgcattctaaatggctgtgatttatcatgaccattttgaaattgggtcctgtggccatatgctaatttgactcaaaggaaattctgtgctgtgtgcttggatttcatgcttaaaaaattcagcaatagtttcaatgctcttttaattaaaataagatgctttataacatttcccacatgatgtggaatgtactctgtagctcatatatgaattaaaacccttagaagatttacattttctggtctggcaaccttcatttttctaatttatgtgtcctgtttgtcctgaaggagttgggaagttgaaatttacagccatcccaaatgagagagttgagattcttgattaaatgagagcttgtttgtgtattcaaatggaaaaatgtgggtggacaaaattaaatttgtagtgggttatctcctgaacagttttctctttcctggtaatttcacactgcccaactatgcacatggtaagtatgggagaaaacttttttgtataataaaactttttagcagtaactgactggaccatggttgggcatctattccaagttattctgatcagcacctgcatctgagactttgtaattggctctatcatattcccagtatgccttttgtgtgtggccattttctgctatgtaaataggaaaactgaaaaatcaggtctgcagaaattgaagaatgaatggggagaagcaaagacaagcaacagagagaaagaattcccagtcattcctggtgcgctgcagtctccagtttctgtgagtttccaagacccagctcatccatgcctttggggtctttgaaagatccctctatctttcaggggtctttgaaaaacccctgtttatttcaaccagctcagatggttgcctgcatgtgggagcaatgaaataacctatattgcttagatttctattttctgattagatggtggctaccatgctatgtgtatattcttaaaacaagcccttgtacataaattagataatattggatggttttggttgagctggtctttggcttaaatgttattgacatttttctgaaaaaatataataaatataggacatgtataatctcacacaagtttgaaactatttaatagactcttaaaacaaaggaagggtgtctatgtagatgtgctgattggttccaggtctaggaatccaggccatttgcagtttgatttgtggagaaggaaaagagactacaatctctcagtggtggtaaggaggcaggatggagtggggaccagaaacgcctctgagatacaatgtcccaaggtccagtgtttttatgattgggaggaagactgctctaaaatctttgacatttgaagattattaataataaatgtcctcactaagttcctctgttcataggatagtaatacaaaacaaattgtaccccaatgcagcagtgtgaaaaaaaaagaaggaaaaaaggccaagattattaaattcttatgttcagactgagaaccagaaagcaaaagagagttaatcattgagttgtgtattagtctgttctctcactgctgataaagacattcctgagactgggtaatttataaaggaaagaggtttcattgactcacagttcgacatggccagcgaggtctcaatcatggtgaaaggcaaaggaggagcaaagtcatgtcttacatggtggcaggcaagagagagggcatgtgctggggaactcccctttatcaaacaatcacattgtgtgagacttactcactatcaatgagaacagcatgggaaaaatccacccccatgattcaattaccttccaccgggttcctcccacaacacatgggaattatgggagctacaattcaagatgagatttgggtgggaacacagccaaaccatatcacgttggaaactgaatgtataggtggtcctatggctagatgtcactgatgacaactgtttgcagtcttctgtgtctggaaaaaaaataatagcttccctgcttaggaagtcagaatataggcggtagggagaaaaaactgttaaaaaaaacttcaaagactggaataaactacatttttgtagagctactatattaaaatataagaggaaaaagaagtggaaaagccggggagtggaaatcgcaggcctctgcagaaaggagataaacaagtgcctttgggtgggatcatttgtgattgtaacagaaagacatacaaaaagacaagactatgtccttagaagcagagtggcaacttcaagtttataattactaagaacccctatgtacacagcatttggcatatgcaaaatatattggcagatgcattagtaaaatttaactatcgtaaagcctctgggagcattgacttggtaaagtaacagaatctccattaaagcaaaagtaatgaactgactcagcactcctgagtaaagtgaccagatgtcagaggtaccctgaaggacacagagggcaaatcaggtgtattttctggctacaatcggaagggtggcacagagagaaacaaaaccatgaatacatctttgatttcaggtttaactcaaaggcagtgatatttacctggagagcagaggaaagcattgatgcttccaagccaattctttaaagaggtgtgggtggagagtgtgtgtgcatgcatgtgtgtgtgtgtgtgtgtgtgtgtgtgtgtgtgtatgtacatacacacatatacaattagctccaaggctttaaataaattcaacacaagtatttattcagacctttgttgtgtaaggcctccaccaggtcctgggagggaatacatatgtgtgtgaagccctaagctttgtttaaataaagctaagggtcaaagaagagtgaagagcaccccacctccaccccaagttctctcccccagcctcttccagtcatggctcttgggaaaccctgcagtaggaacagatgaatgtgtgtataagtagttggaaagggaagtagagatgatacttagacaacataaatgagagaagtgtgaagtgtttgcagtcagagtacctattcccaatagcctgcttttcatgctgataaaaccattcaatcttggatgttgagttcaattttttgtcagtgaaaaatctgcccagagtcttaaaaaatgcaagcaagtcatctgtatatagcctcagagcattgtattttcaatgtactgatttgctaggtatatattgaagtggcctttggaccctgagtgttaaatatggagatctgaatgttcttcagttcattttaattgtgacgaaatcaactattgaggaagaacacacttcctgatatagtctgcagccttatagagagccaagtatgtcacctttaacatataattcaagttcatttgttctgattaatttgtggggagttgcaggattggaatttagaatattttaagtgaaattgttggattacggattaaaaaaattacaaaagtcaattatgtacaagttctgggctaggtcctagggtacatgccaaaggaatgtgaggatattcccagtcttcatttcagagcagagtcacctggagcattttagaaaactcttgagactcaggcagcactcagatcactggagggggcacttagctcaaataaatcagaatctgcgcagggggtgcccatgcattactcagttgtagagctccctcctcaccgggtgattccaagtgcagccatgtgtgagaactagatcaacagtctggaaagcttataaaactacttaacatcaatttaaatataaatctctgggcattagtctgcggttggtaagttttacaggctctccagatgattctgttgcatgtggaagatttagaatcagtggtatagaccctgctctacagatgattatggtcaaatgagggaaaaggtgacttgtgtattttttttggaaaattacaagaaagtttatgtttaaatgccaaaagaataaaagacaataaggagtgataagaaaatgcaagaggtaaatatttagtgaataaattaaaaatgatttgtatttagcatgtttattcagatggaaatagtatttttaaagtgtataaatttttagaaatacatttttattatatattttcactatgtattctactatatagatataaaattacctaataggtatacatattttcagggtacctgtgataatttaatacacacatataatttgtaaagatcaaatcagtgtaattggggtatccatcaccttaaatatatgtcttttcttcatgctagaaacattcaatttattatcttctagctattttgaaatatatcatagattattgtaaactgttgtcaccctactgatctatcaaacactagcttttattttttctatcaaacagggtgtttaatcaacttttatcaaccctttaatcaacctttgtttatccccttacccccactactcttcgtggcctctgctaaccaccaatctgctctctatcttcatgagatccactttttttttaattccccacagattagtgagaacatgcaattgttgtctttctgtgcttggcttattttacctaacataatgacctccacttccatcaatgtggctgcaaatgcctgagttatggctgaataatattccattgtatatatatatcacactttctttacccatttatccattgatgggcacttaggttgattccatattttggctattataaatattgttgccataaatatgggggtagagatagtagatgaaaacttaatcttcttatctgaagaattacttaaaattctaaagtagaagagttggaattgagaactagatagatcatttagtctctgatgatctgtctgtttgcagaggggagttgggtggaactgggtgctctgggagtactctgatggtagaaagagtcctttttattccactgtggaggtggggatatgtccttgggtgtggttttgagcctggatatccagaagcagtgtttctcaaatggcactattctgtatattcctattgcacgacgtgtatcttcttgctaaaatcaggcagtatcactatttttctatgggatgtggggaatatttgatagaaatattggtagaactttcttattttaagttttatttccataatcttctcttagccctttggtaactattactggtagtctcaagaaaatcgagtgagagataatatgggagatttctttagattttcatagcacttcatctgagtaccaatagccttggattcttatattaataacagtaccctaactcttagggttctttcgcagacttagatgaattgatatatgcaaatgtgcttaggaaaatgccatgcacatagtgagccctcagtaaatgtcagcaattctataacttcccttccactgctgttattcccaacgtcatttgcttcctgaactgtgggacccttgaggtcaggccagatcttttatctttatattccctgtctcctagcacaaggtttggtgcagtatcaacacccttcaacatgtgctgaatgaaggattggccagcttagatctgatttaaccctaaagaacttatgcagttattttaagagtattgtatcagtgtttcagtgattttctccctgagtgaaatgcttccaaatgccctgctatgttaacagtgcagagaatggctgctttagaagaaagagccccttgtacactcaatagtccacagcctccccctttaccttcctgatggtgggcaggtcactacatctccccatctacctccctgcttgcttagggttccctgacacacaggtcagccctgattcatcattccctacagaagactgaccttggggccaaaaggctggtggatatgatagaggggatgaggagaggaaatggatcagtgacattccagctggacacctgaatcccttttcaaaagagcatcttgttttgtccccttaggcatcccctaagggaaagttagcatgcagttatgaatgagaccctcgctgctgttttgatgttgtaaaggaggagggaaatctacaatggcattgaggaataatgcaagtgcatatatttttcctcccaaagaacccaaaagcatttccacctctatgttatctgatgctgctgattttatgcttcaaagaattgagaatgaatacctggcagtaagtactaaatctatgtgtggtgactgacagattaagcactagggatgttaaagattagaccacggatccccaaacagtgaatgtcagtgttattttccatcttgaaatggaatgaagttgccctcatgattcttaccacagccagcactgttatatcctcccaatttggttcttacattacttcactcttcagaacatcattcatttatttaaatggtatttcttgagctcttttcatattatggcttggttctagctacagagaaggatataacaaaatgtgagacatggtctttggacccaagaagcttctatttcaagaaatggaaaaataaggccgtaaaagtcatgattacgtgcttaagttctatgattccatggtgaaaggatattttgaagtacagggaacagcacagaaaataatgctacctttcaggataagtctaattatacctcttttgttgtcagcctgtgagagctgagggtttgtggcttttaattctcctttaggctgtggaaggcagtgggggtgcggaaagagtgtgaccattagagttagttctggattcaaatcccaactctgctgctttccacttgtacagattaggcagttgacaatatttcctagcagaactaaatacatccacatctttcagagatgtgaggaattgcactaatgatcacagctggaaaaatgctgttggagttgggcggatcatgaggtcaggagatcaagaccatcctggccaacatggtgaaaccccatctttactaaaaaatacaaaattagccaggcatggtggcgggtgcctgtagtcccagctactcgggaggctgaggcaggagaatcgcttcaggagaacccgggaggtggagtttgcagtgagctgagatcgcgccactgcactccagcctggcgatagagcgagactctgtctaaaaaaaaaaaatgctgtcgttagaaaggccttcaatagatggtgattgttataaacaatgatcactaacagtaaagatactgcttttatgaagctcatgcttaaatgataacttccagcaaaacaactccatttaagctgttttctttgtactacagaattagcacttttcgtccctctaaatagacagacaatatatcatggagaggtgtttccttcccttgaggacgcaatatgctattttatttttcattccattgacatttcttaagaattcccaaagaaggaagtctcagctggcctccttccacatattaagagagaaatgttactccattatgttggacttctgattcctctttctataattttaatagtcactgtgttgagtagtttgcactatttttctcatttaactatcctcagagttccacaaagtaggtgttaaccccattttacaaattggagcccaaattgcccagccagctagcaagtcattaagtgggatttgagctctggcagtctggctgcagagcctgtgtttctcactgtgatgctaggctcgcctgcctgtgtgcctgtcccaccaagctcagggctgcactgcctccacaactgctccttctgctcctgcctatataggctttagtgccatttgtgagaatacacagtaaaggtagtgtcttcgttagctttctgtggctataacaacacagattgggtagtttatcaagacaagaagtttacttagctcacaattctggagacttggaggtctaaaagcatggcactggcatctggtgaggttcatcccaagacagaaggcatcacgtggcaaacatgtgagatagaaatgggactgaccccactttgtcgacaactagcccacaccggtgatcatggcattaactcatttatgaggtctctggtctcatgagttaatcacctcttaaaggccccgttacttaatagcattactaaggcaattcaattttaacatgagttttggagggggacattcaaaccataccaggtggttacccacaacccccattcaaattgatggtaaataatgaatgttaaatttatcttctcttcagtattgattcccatagtccatattctttactggctgttagattttcaccttacatgctccaatgtgcctaacataaaatgatcttagaacctactttgtgaagatgctgcaccatcctgagatggcacaagaggaaccaggccctgagttctgctgctgtgcttcagggggggcctgcattagccatctctggctgttcccactcaagagtgcccccccccccaaaaaatagttcacccagaacccatgctagtcctttcatgcctcagggactcaggatcctgtaacccacttaaacatcacttacctcatctcagggcctaccaagacctatggcctgggcctgccctcctgaggtctgcctggcaccaccagtgggagcacccctagaccccagggatatacagtaactattgggatgatgctataacttgcaggctgtcctgatgatcattaaaacagtgattcagtatgaaagtgctttgcaaatgatgagatgtcacacaaatttagccactgtttggtcattttcactttatctttgaaagctcgtgtttatagctaaacatttggttagaagattaaagtctatgaaaagatttggatccagtaggtcacagcttactagaaacagaacagagacttaaaccatgtgcctctgtcttctggagttggacttttaccatgaggttgcttatctggatgaaatctgagggctttacagtctaactttctgagggagtcattcagggaacgttttagtgtcaagccattaaatcacacctcaaaaggttggaagtggcccacatatgagtccatataggtgggtctggaaaggtggggcgagcaggaatctctttccattatgatgatggggtttctaaagtaattattgctttaaaaaaaatctgcctctgccattttccagtcacactgttcttggagcgagatgcatcatcaatacttttcatactaaacgttctctcctattggatttacctggattctaggggtatttttttcacatttctctggagacaagtagtgctgataaagattttataaggtctctcttgctctcaagctcgttttccttaacttttcttgtcccagttaccagtttatttggtccccagaaaccttctaatcttcatctttaatgataaatttatcttttgtagttctcctgtcaaagcttttgtgtctagtggctcattttgcttaattgctggagttttctctggccttttgttatttggtcctgcgtattttcaaagattctgtagaattttcagactgttactctgatgtttacttggtagattgattgctaagttgcattgtcttcagaggaggtttttgaggttgtgtctattataatgtctgcttctacccggagtccattgcacttggagtgcttcttgaagcccctgagcttatgctgtgataaaagcgtgaatgttttactgtgtcaaagcactgtggctcataaggcttcataagctctggcttttatatcagagcatctcatatggttgtgcagattgcatcctggtcaagcatgccaggatgaggggccaagggtgtactgaatgccagcctgtgcttcatttgccaagccttgcatctgatgtaggactgtatcctcacaggggacaccttttcctaatacacacaaaggtatcatgtgggctagcagctgttctgctataacttagctaggtgtctttacaggagaaggtagtggaagaggtggtggtatttctcctcgggaactgagattagcttactcgacgggaatcttgaagtgtcccaagatgaagccattggtgccccactcccccaacagttgtttaaaagttattaaagaaccaattgacatttgctagcattttaaatgctcaggatgacttatgaggctatgtcagttattctttactcagtaggggacttggagctacaggtctgatttcagcctctgtgcagcccccgggccacccttcctgctgaatctaagccccactctctctagaggattatcttggggtttattttggctcctggctttgaatctgaattgctgcccctcaagttatattcaaacaactctattaagataacgttgtctccaggggctccaaccagccagtttcattttccaactagtttggttggtcagtgcccataacaggtccacttgaaattagagctgcgtttttttttttcttttctttttttctttttattattttactttaagttccagaatacacatgcaggacatgcaggtttgctacataggtatatgtgtgccattatgatttgctgcacctatcaacccatcacctaggttttaagccccacatgcattagctaattgtcctgattagagctgcattttctagaagtcaacaacatagtgtcttgaaagccttctttgtcatattgcagttgtgtctgagacctttatgtaccttagtttttttgggttttccttccccatgtgaaccacagttaccctttctctgactagtatgctgaagttatagtacatttctatttagcaggtgtttcctgtggttgccttttgttctaaatctatgattgaaccttatctatattgaaccaagtctaatatctatttgcctggacacctgtactaacataatatgattctttttgtatccacccttatattaatctggtaggatttccataacaaaatactgcaggctgggtggcataaacaacagaaatatatttcttacagttctggaagctggaaatctccaatcaaggtgttcgcatgtttgctttctcctgaggcctctctccttggcttgcagacaacttccttctctatgtgtcctcacatggacatggacttttctctgtgcatatattcctactgtctcttcctcttatttatttttttgagatagggtctcgctctgttgcccaggctggagtccaatggcatgatctcagctcactgcaacctctgcctcccaggttcaagcaattctcctgtctcagcctcccaagtagctggggttacaggcacctgtcaccacacctggctaatttttgtatttttagtagagacaggatctccaactcctgacctcaagtgatccacctgccttagcttcccagaatgctgggattacaggcatgagccattgcacccggcctctcttcctcttcttatggggacactggtccattggattagggccccatgcttatgacctcacttactcttaattacttctttaaagtccctatctccgaaggatatgaacagacacttctcaaaagaagacatttatgcagccaaaagacacatgaaaaaatgctcatcatcactggccatcagagaaatgcaaattgaaaccacaatgagataccatctcacaccagttagaatggcaatcattaaaaagtcaggaaacaacaggtgctggagaggatgtggagaaataggaatacttttacactgttggtgggactgtaaactagttcaaccattgtggaagtcagtgtggcgattcctcagggatctagaactagaaacaccatttgacccagccatcccattactgggtatatacccaaaggattataaaacatgcttctataaagacacgtgcacatgtatgtttattgaggcactattcacaatagcaaagacttggacccaagtcaaatgtccaacaatgatagactggattaagaaactgtggcacatatacaccatggaatactatgcagccataaaaatgatgagttcatgtcctttgtagggacatggatgaagctggaaaccatcatcctcagcaaactatcacaaggacaaaataccaaacaccgcatgttctcgctcataggtgggaattgaacaatgagaacacatggacacaggaaggggaacatcacacaccggggcctgttgtggggtggggggagcggggagggatagcattaggagatatacctaatgttaaatgatgagttaatgggtgcagcacaccaacatggcacatgtatacatatgtaacaaacctgcacattgtgcacatgtaccctaaaacttaaagtataataaagaataaaaataaaataaaataaagtccccatctccaacatagtcatactgggaattaatgctgcaacatatgaattttggggggcataattcagttcataacaattttcacttgccagactttcttatttaagcatatccagtagatattagaacaaaaacaacgtttaatttataccttttctgtccatttgggctcatggagctatgttaaagacttcatttccatcctcagaaaaacattccatttagcaataattatactttggatcttgccccttagacagcttcctaattgttatttccaaaaatctaagcctcatttttggaaactgctcccctatgttaagtatagtgaaacgcttccagacaatctcattttgttaaaattaaattggtgttttctggaccatgtttgtcccataagcagcattctcaaagggctcggcaggctggggcccccagcctgtgcttgtagacatcatgttgatttttaatcaaaagccttattttggcagcttccgtttttttgattgtttgaaaaatacttcctgatggcttggagtttagattctcagttgttggatcctgaagaggagtttgaagccttagtttttcaggaaaaagcacctgacctgtgtatcttaagctgctaaatatttaggaagcatcagggcttatttccacttctaccacacaatattgaagcaattcaacaattgaatttttttttccccgctagaaaagagggtttttcaggccactttgaaattcaggtggttgatttaaaaatgcaaattctttgggaattaatcatgaaatgtttcaggatttttataaggaagctcatccgctcagtgaaataagggatgctttcttggtcatgaattttctttttgtactattttgttagttacttggtgggctagacagtatttttgggtgccactggcaagtctaaaacacaggaagggagaaagaaaacagctgacacttacaaagtctgacccgttctgtgctggaaacatttggtaaatggttaaatttactgcatatgcttgaaacgaatagctgaattaataaatgaatgactttattaattcaagctgttctatttttcaaataatccgaattagggatagtggcagagaccatgtatgctatgtgatcattttcctcctgggcacataatgggaactgtgcaactcactctcaagtgttgttgggtagggccatggggttggattctggccaatgggatctgttaggaatgacatgtggtacttcaaaacctaaaaatcctcctgcatgatcctctgcattttctgacttcctttatctactgactggagggtgctaggagatggtggaggcataagacagaagtatgctgtgtcctcgaaacacaacatggagcagagcccctatcaatgcacatgaagccacaatgtgattgagcaagaaataaacctttattgttttaagtcaaggaaatttgattgtgggttgtttgttacagtagcttgtgttaatttttaaaagtttcatgatggtgtagtttcttagtatcattatgctgaaaaatatttgacctgaaagcaacaaatactgcaatcaaagtacctatgccagtttctgttctattaaaaacaaattcccttgctctatttattccaactaaaatcacagagatgtgctaatttacaggccagcagagtgcttgtcacatgcacattaaaatggtgaacatgcaatcttttagggaggtgaatagtggcaggtgtctattcttcctctaaatcctgcccaggagactgccttgcctgggcataacccagcagatgaagtcatctacctctcctggccaccatcatctgattaagggaattcagactacatgctttagatggtgaacatctcacaaaagggatatgttatcagagataaagtgtatgaattccacgtatgaccactgcatcatttgtgaatgcttaccgtatatgactgtatgaatgggccacctgcatctcagaatgtttttggaaaaagggattaaatataattgaaagaaacccaagaaagagcaaaaagcaaaggctataaggaatgagtctataaggttttattttttttcttcccctttgagaggtagtcaattcataacctagattcctccctagccgcacagcccaatatggcagccactactcatatgtgactatttaaatttaagtttaagttaaaattaaataaaaaatttattttctcagtcacactagccacatttcaagaatacaacagccacatgagttagtggttgccatactggacagcacagatgtagaacatttctgaaagctctctcagtgctgacctagagctagctttggtattttcatcttttcatgatgcaatacaattgccaaatttcttacttctcatatactcaaagcaacctcttgaaaaaaaattttttttttgagatggagtctcacctcttgaaatgtttttaagattgttacagtataaattctggaaaaggttctagaacaaattacaaaagattgatttctgagtacacattaagggaagctgtgataattagaagccaccaagcattcactaaaattaagttactacacatttacttcagtgactggaataaaaatctaagcttcaatgaaagaaaggaattatttgtttttattgccaaatatttgcagttcttgcacacagtaggtactcaacaaataacttttgaatgactattagagaaataaaattgatatagtcagtttcagttttcatcaagttaaattagaaaagtccttatgctgtcattgaagaaatggttactgggtcgtagggcagttgggtgagttgccaatgagttaaccagtcatgagaagtagctgacgaagagagcatgagacttgaaattagatagggacctaccttcaattcttggctttcacttaacctgtgtaatcccaggcagccatttcacttttctgaatcactgtttcttcatcctcaaattgggcataatagggtgctcatatcaaatatggtgatattaaaagctagcatgaacatagcctggaaggtttctagtagaatgttgtggagtggttcttcacatttagctagccagtgcttctgtctctgacttcagtaaggatatactgattaaatttgtggatgacccaagatggagtaagaatcagaattcagagggaccttagtagacaaaaagataagctgaatacaatccttaaaagtttcatatgggtaaataataattaagaaaactgcaacagtaattgacagaggacatgtagtttaacctcattgtgcaacagacttgtggattaaaaaataatgtcattcactgtgtgatgtggctgccagaatttagattttagcaataggaataaggtatgcagagtagcacatcagaacgcctaggaagttaaaaatgccaatggctgggttattgccagagattaattaattgatgtgggatgcagctttggcattgggatatttcatgcccctcccctgccccgggtgatcctaatttgagaaccactggtttaggctgagggaggtcttgacgatttctgttcgctccacttttacgtagtctattaagttacttgcatggaaaaatgcatgctgcatgtagttccgaatgccccacccaaatcttggagcgtatcaggaagagtgtggggacagtgagtggatggcaattataagagacatgttgaagaaaacaaaaagtttgtcctgaagaagagtaggaagaggtaaccgccttgaacattgcctgcttggtctattttaggaagctgggttcagttcttctctctggtattccagaggatagaaagcagtccactgggtggcagcttcaggagatggatgtagggaagcatttgcttactacagtgctttctagagatggtgggcttgccaggcgctggagatttacaaagacctcacagattttgttgagaatttaaagggacttaaatgtttattggcagattcaacttccagaaggtttcttttcatccctctcctcatctcttactcttttgctttcatccactgccttggccacactggtctcatagatgttatttaagccccgccatgcaccatctcagggtctttgcacttgctgttcttcttggttgaaatacttcacctccagatatctggacaatttcctctcatgtttttgctcagattacaacctttccctggactccttgtccttctttctttttagtgtttctctatccccatctctcttacacacacacgcacagacacagactcacacacacaaatacgcatatatgtgtatgttttcctctaacaaaatataagccccacaagggccaggacttttgtcggatgtgtttgccaatgtatccccagggcaagtatagtgccaggctttcagaaatgctcaagcaataatttgttgttgaatagatctctgggatcttctggttccttggaatttcaccagtggtagcttgaatttcctattcaggcctggacaaacatcctgtaaagaatgccacctaatttgtatctttgaaggatgaatccaataatatgtgggtacagtgaccactttcaagcttttcttctttcttcttttctccccctgcatcaaacaggaacagcatcttctaaaaacaaaactttattcattggtcagcagtttcatgcaaccattgagtgaaatccaatgtggaaaggaaatccaaaactttactgcagtgtaatttgtttcttctgtgttgctttgtgtacagtaaaggtcaataatgcacaggaaagctaggtttaatttctttgatgtgtaaaaattagtgctttgtcatcagttacagtggcaggaggacaaatcactggcacataaagttgttcctgctacataaattacaaatcttgttcggaaaaaaaatactcacatcatcccttgttattttaaaaatgccaacactgataaacagtcagccttggacatgtattaaaatcttcaaattgtactaaaataaatttagccttttaagataacacctcattttaatttcatacatgattaaatccatcaattcaaaggtcttttaagatgtaagttttgaaatcataatagtaccctctaactccctgcgaaaaacttaaacctctttctacttcattaataatgttcttgacagacaaaatttttaaagaaaatcctcagctttgttttgtgtttttgtgtgtttttcttgagaagaggaaattaaattatgatcataaatccctttcatttttagaactagatttttcttttaatcataatccagaggaagtggaaaaagctttgtgaatcaagttttgtatttctaacatgatgacatagtctaaattattgtccaatattcagcaaaatctttatttctatatgtggcagaactgaatattttagtctcagcataaatagtgcctcctcttccctatccaggttgatgactgcttccttgtgactttgcaaacacaacttcttcttattattattatttcaataggatttgggagaaccagtggtgtttggttacatgaatatcttctttagtagtgatttctgagattttagtgcacccatcacccaagcagtgaacactgtacccaatgtgtagtcttttatccctcatccccatcccaccctttctcctgagtccccaaagtccattgtatcattcttacgcctttgcgtcctcatagcttagctcccacgtatgagagagaacatacgatgtttggttttccattcctgaattacttcacttagaatagtagtctccagttctatcctggttgctgtgaatgccattatgttattcctttttatggctgagtagtattctatggtatatatataccacattttctttatcagcttgttggcggatggacatttgggttggttttatattttggcaattgcaaattacgctgctataaacatgcgtgtgcaattttttttttgtataataacttcttttcctctaggtagatacccaggagtggaattgctggatcaaatgatagttctacttttagttctttaaggaatctccacactgttttccatagttgttgtactagtttacattcccaccaagagtgtaaaagtgttcccttttcaccacatccatgccaatatttattattttttgatttttttgattatggccattctgcaaacccaactttgaatagactatcaaaggttggggctggatatggatctgattactcaccctggccccggaggccaccttcaggcagagcagtcctgcagcctttccagaggaggcagcctcctgcccatgtcaaagaccttggaggctagagtatttgcccttctgctctaatcaagatctccttggaaagaaagctcaatcagcaaatctttattgagtaccttccatcagatagattctccagccccaagctggtatggtgaggataactatatctactgtaaaatacctgacctaaagaaacaatgcaacatgtgcatatacaattttaaaagaaaagctgttcaccattttctaaaggaaaaattatatctataatgtatgtattcacatgtttatttttatatatcaacatttatctgctttttctttccatgcctcccctctttccgtcctttcttttcctcctggatacatccattcctgcagcttaattcttattagctaagggttatattgcagatgtatgaattaagagcaaaggctttagaatctggcagatctatgtttgaatcccagctctgccacttcacaaaaagattgttctatttgttattgttactggcacttttattgccatcatttgtagtatagacaataattacttgtgctatttatgtttattagttatttaccatatcaggcactaagggatttgcatgtattttgaatttaatccttgtaacaattatatagtgtaggtagtattatccccattttatggctaaggaaactgccttgagattttaagtaatatgttgcccaaggtcacataataagtatgtaaaggaactgaaactagctttgtgttttgaacctacggagattctctttatcctctgtaaaatggagatactgattcctgccatggtagctagttgggatgattcaatgatatgggatatttcgcatttgcagtttggttccctgcatataacatatgctcacacaggatatggctgttcctgctctgcttctgctacctccttcaaggttgaataatctttctttcttctctcttagctatttcccagcccctcacttaagtttataactatattcttttcatcaacctagaaaaccaaatgaagcctgaagtattgagaactcaggaaatgtttttgaggtcccatgtgattcagtggcaaaggcagagcaggtgcagatgcaaacctctgggctcttagatgtgaaccctctgcctggtgttttatcctagcttgtctctgcagcaaagcaggtgctggagtctgagggggtccttgaggccagcttcccctgggcacagaaatgtgctctccctagaaccatcacatggcgattttcctggcgatcaggggccctaaatggtgaaagggttttggccatacatcactaaaagtgtgttagtaagaggcatgaggccccttgggactggatgtggtggatgtgtcatatcacatatgaagtggcatgatttgatagtgtgccattttctgtctgtaactaaatcaaattctgtggttgaaaaggactcatacataatcttggtgtcctttaacgcagtcatagttcttgtgttaaataagttaggattggagagttgcatttctagacccgaggggagcggttctggatcttgctctggtttcctgagttgctgcagcacccaaccctgagcaattcctgtgactcgtggtggttgttatagagagggtacacagtggtgaatgagaaggaggcttattattgttatctgtaggcaccacttttgcttgaaaatgtgtaatggcaaactcaaaagtagaaatacttattccctattaattgtcttttttgtcataactttttaaaattttttgggttctttgattcaaatttcacaagatctcacctaatatgctggtaaatttcaccagaagtatgaagacagaataaactttcttgaatttttttccctgcaatgtaacagtctgcttctagatgacttcttgaagaattatctacctaatttgtattttttaggagacatcagagacagaaaaaaattcacattaaggaagatatgtgtattatataagtaaatcctctttgcttacagttcttttttaaaacaagcattttatacaaagtaaaataactttagcagtttggttcatttttaaaatatttcatgcctgcatgcatgattaattgagacaatcattccatttaactaatatttgagggcatactatatgccaggaaatggggctactcaggccttcacagatcttgtaatctatcaaccaatacaaacaaataatcaggccattataatttagaggacagtgttttgagggcacatggcaggatgatctaatgctgacttggtggaggacgcaatgacttcctcctgaatgaagtagggtttaagccaggtcctgaaggagagtgagtgttaacctggtggagctgttggggcaggctaggggctttggactagggaatagctcatgtaaatgcctggagtgggcagccagccatggtgttattgtgttcttcttcttctcagagatatttacatgggcaagaacttcagattatacttgattgtgacatttgcactttcaaaaaacattgcaaaactgcctggtgaaaaccatcccagtcttgacaggtgcatagtctgatatttccaaaggtaacagttgtcacataggtggtcctgccctgttgagacacaagcccgttaagcagtttattttcaccccatggccagattggctttggagcaatcaatgcagcctggtgcagcctggagaagagatcctactggataaggtgggaagcctttgtaaatcaaaggttctaagactgctcctactgggaagatagaagtgatgggtggaatggatggataagtataaagaaattctttggttctagaaccctcaatgtaaaaaacattagaggcacacaggtcataatcatgtcgcataatttgattaatttcctaagaaaccttaatactacaaagtcatattgcatcataaacttacgttttatggagcaaagagccctgggcttgggaagggtccacagggtctgggttctagttccaaccacatgccctggggtcaattatttaataacctataatgaagctgtcgtattctatcaccacgacatggatctggttgtgccaaggtagacatttgagattacataccgtaaaataccgtggaaaataactgtggctctcaccagctctagcctctttctgggcttcatagctccccttccccagtgctccctgagaatgtatcattcagaccatcttctgtccttcattcatagtcatagtcccatgcctcagtgattcaacaatcaggctctcttaccctatttttgcttacccttcttttttctttcatttcagatgttcagtaactgaaaacaaaaaaggtttaagtatgataatgaatttttttccacactcaagaatataaacattgaaaagattggcctctttatgctccctacaatgagtgacaggttctgacttaattcaacttaactgtagagattattggcataagagttattaatataaaagtcatgactcaaaaaatatctccactattaaatatcccctgcaaaactttattatccaggtcttggcgtgagctttgattgtgttgaaagaatgaacttgtgtttttggccctgtaatgtgaatgatggacaggagagtgatttttctgttactgggtggtcatcctcttgaacaagaggattctgaaagtttctttttatatatttgtgtatgtattatttttccttttccatttttgattgtagtgaaagttctatctctaagcattaaaaattaaacatttaaaatgtgcttttgcaatggggaaaggactccctatttaataaatagtgctgggataactggctagccataagcagaatagtgaagctggaccccttccttagaaaaatcaactcaagatggattaaagacttatatgcaaaacctaaaactgtaaaagccttggaagataacctaggaaataccattctggacataggacctggcaaagatttcatgatgaagatgccaaaaacaattgcaataaaaacaaaaattgacaaatgggacctaattaaactgaagagcttctgcacagcaaaagaaactatcaacagagtaaagagacaatctacagaatgggagataatatttacaaaccaggcatctgacaaagatctaatattcagtatgtataaggaattttaaaaatttacaagcaatgcttaatgacgagttaatgggtacagcacaccagcatggcacatgtatacatatgtaactaacctgcacattgtgcacatgtaccctaaaacttaaagtataataataaaaaaacaaaaacaaacaaacaaaaaaataatttacaagcaaaaagcaaacagcccctctagaaagtgagcaaaggacatgaacagacagttttcaaaggaagacatgcaaacagctgacaagggatatgaaaaaatgctcaatatcattaatcattagagaatgccaatcaaaaccacaatgagataccatcttgtaccagtcacaatggctattactaaaaagccaaaaaactcagatgctggcaaggttgtggagaaaagggaacacttatacattgtttgtgggagggtaaattagttcagccattgtggaaagcagtggtgattcctcaaagaacttaaaacagaattaccatttgccctaggaatcccattgtatacccaaagaaatataaatcattctaccataaagacacatccatgcatatgtttactgtatcactattcaaaataacaaagacatgggatccacctaaatgcccattgatggtagggtggataaagaaatgtggtacatatacaccatggaatactatgcagccataaaaaagaacaagatcatgtcctttgcagcaacatggatggatctgtaagccattatcctaagaaagcgaactaatgaagaaacaaaaacccgaatactgtatgttctctcttataagtgggagctaaacagtgagaacacataaacgcgaacacaaagagaagaacaacagatactggggcttatttcagagtggaaggtgggaggagagagaggatcgaaaaactacctatcaggtgccattactgtgcttattacctggatgatgaaataatctgtacaccaaaaccctgtgacacacagtttacctatataccaaacctgcacatgtacccctgaacttaaaataaaagttaaaagaaaaaataaaatgtgcttttagaagtatccagaccaggccagagcttgtataaatccatattactatcttgcagttggtcaaagtagttaagaacctgtgtaatagtgttttctgggatgttgcaacaactttctatctttattgcaagggctttctgtcttcctattatactaattaattctttcagtctttcctgattattgatgccatgatgattttttttttaagaatttgatcctgcaaacttttatgcctaaaatctctctagctttactattgcctccagcaggaatttttcacctaagttcatcaattgcagtcaggaaactggtaaactctgagtctttctgcaaacttctgtgtgtagaggatccagagtttgagtcagaccctgaaagctatccttgatcagatttagaatatcctaactctttagtaagaaataaacccgtctagctttacatgcagccaccagccgtgacgtgagactcaccccacactgacctattattcaacatttcctgatgcttccatacttctctgcctttgaacctgatgatcattctacttataatgtcctttcctcatccttagctttgcctgttgaaaccttcaagattttactccagagccaccttgtctggagagattttatttactttgtgaggaacaaaatgctgctcttttatcttttctcctcctttataacactcatcacctctccccactaagtttgtggacaaggaatgtattctgtttatctatgcattcccagcccagaggaaggtactggcccagagtaaatgctcattaaatattgtgaataaatgggcaaaaggatagaagacacattctttacttagatggagttgagataaacttagagagttagtgctagaatcaacattgccttcttgcaggcaaatgatttacataatctggacatcaagttgcctgtcccctggatgaggtatctcagtctcctatgttaaataatagtaaattgattctttcttcaacacagagtataacaaatacctctaagtattctaagttttatgaaacaaaagatttctggtgctggagattgattttggtagttataagcttctcaggatatctccaaagagacaaggggcctaggtggatagaaatatttcccttaaatcagcctgataaaaagttctccatggtaaggtagcctttgtcttgtattaaaacgcagttttctcaccaagtgactttggcaggttggtgaatcctttaagaaaaagagatctggtctggagttgtggtcccccggagatttagttgctattgtgatcatctgatgacagcagaaaacccagggggatcagcatggtttatttcagactgcagggatgtcagcctgttattataggagtgggagctacctaggcagatggatgcttcctgatttgtggattgggaacacgaattgagcagcagccaatgcagtgacacttgtaatactcttctgaagccctccttttttttttctgtccactgagaaacagtacccacctgctaatctacaaggcaaagccatccttatttcaaagtgtatttgatgcaacaaaattctttatgctgaaaggctttaaaaggcctctaaatttctagaaatgagatttaatctgatatttgaatcttatgccttatatccaaagaacagtctctccctagtccccatttctatatatagatgcagaaatttcataattggaaacctgtgactttagcttatggcttggtcccttgtgaagaatgtattgtgctttttaagtgatgtgtgtatttgtctgaattagtctatcagaagtttctttttgagaatagccattaatgaagatgagaaacagagctgtgagggacatgaggaggaaaacaaacccattaaagagaggaaagaactccctgccccaaccccaccaacccaatagcatttaaggccaccaaagggaacgttttctgtgttactgtttattcaggagctggcttctaacctgccatatgcttcactctatttagagagcctaggtaatgttctctcattttgtaaggagataatattacttaacctaagagcttgtgcaaaactgggggaaatagttggctaataagttacatgcatccatgagttgcacaatagagatgaaatgatgacaaattgggatgagaggcaatgagtgttgtatgggaactacaggatttaagatttgaaaagaggcattttaagagcccatttttttgctttttctactcagcttaggaccccaattattacttactagcctcatttcactggacttcacccattcacacacctgtcacccaaaatactaccaaatattttctttaatgttatttttgcatttaatcctcatgaaggttaataaagtcttctctctctatgtggtatgaaagcataactgatgactttattggtgcagatatattatggctgcttttgacgtttatgttttccgtccagatagatgaatgattccagtgaaagtaaatcaattgcacccagactgtgggtataaaacaccacgctcagggttttccttcttgtctggcagatagtagagggtgtgaaatattgaaatttgacttaatgctgtatgtttcttctgaaaaagagaatttcctttgactatctcctaaggtacatctgtgattgatatttgccctgtcatttagtgccaatccagggaggggatgccccttttgtggggcctgtttgctctccaagggagccttcatggcttccttcggtctagttggagtaacctgttttttcttctagaggattgaattcaattaacagggattacaaattcagttattaggaatttatcagtgatggcaaatggaattttactggtgtattagtccattcttgcattgctatcaagaaatgcctgagagtgggaaatttataaagaaaagaggtttaattggctcactattctgcaggccgtacgggaagcagagtggcttgtggttctgaggaggcctcaggaaacttcaaatcatgttggaaggcaaagggggaacaggcatcttacatcgcaggagcaggaggaagagagagagttgggggtggggtgccacacctttaaacaaccagatctcacgagagaactcactcactatcacaagaacagaaccaaggggatggtactaaactattcagggaggatccatcccgcctacacacacccatttccaatcacctcctcacctccaacattggggattacaattcgacatgagatttaggtggggacactgattgaaactttatcaactggattcccaacaactggaaacatgagagagtaatttcagtttctaggatgggtttaactggctttcatgataaaaagagaaatatttcttgatccacaagaataaaggtttttgttgttgttgctgctgttttttccaaaagtgatttgagttcctagtgtaaatcaaaaccagacgcaactgtaattgccaattgatggtacaaatggacaggtaaatccaagaagtgtatttcaatttttaaaaagttctgtaccctggaattcccttcttcagcttgccttccacctctgcattcaggagtgctatggccctgatcaatcaaaatgaacactggctgtaaacaaccagcatggtggtggtgctatgcctgaatgtcagccttttctggtcctttgagcaagaattaattgcattctcattaggggtcctgggaacttcagggtcaatctttcttgtggaattgagcacattgttttaaagctatttgtttatttgtccagttcaatttccttctagacagtgaagcacttgagggcagggactgtatttatctacctttgtatctttatcaccaacttggtgcctagcacagagacagttctcagtaaatctttgcaaaataaattaaaattgtagaggatatttagaatttttattctaagataaatgcaaatgtgttattgtgtcaagcactcatctgtatttaaatcccaattactggaatgtattttaacaatagtttagtctgtaccctaacattgactgtgcgaatttctgacttatagtttaaaagtctctagggaagaaaatttcaaaacttcctcgttgctctttttagaagttcaattacagtaataatcagcacctactaactcactgggatatttctagtattatttgctctcatgtgaccatatagcatgtatctcaagtgctgcacaagatttgcagctgtgactgtatggaaagcttgggaaatattgtgctgagctccttttgtaagggatgtggtttctagattctgtgttcagggaaaaaaaagtctaaaacctgcaagtactcatttgtggaacatttaatttcattactttgttagcaaagcgtgtatctggaggtaaacaccaatcagctacagttggcttcaggcccaagagaattgaggttaggagtcaagacagaaagatggctattgcaggaaaatacgtctgctctagactaggataaattttcctattgaaatatgaaatagaccattacacagaagtttgcctaccactaaaagtgttctagaacattatagttcaagggtgccaaattttaagcaaagtcctgtggtttcagtgatgctattttcaaatcatgattcctgtaagaacaatctctgccactaaagtgtagctttctctcacacacttattcatatattctggctgtcctctgtcttccactaatctgagaagtttatggcacaaatctgattcttttccttaaatacttgcattaggttaattcttaggtggcccagtaaccttgcgaagaaagatcagtttggggcaaaccatgtgaagccccctttcaaattcatttctgccctactttctgtctgctttaatccaccacatttccttgtctattttgtactctaggtcaaaccacagcagcacattttaaaacctggtaggaagcgggtctcagagctctagaggaactattatgccagtcttacaaattattttttaattatcggtttctcagacaactcacttggtttactttcaggaaaaatgttatcgctgtaaatgagttgtactttcttctgtcagaaaacataaagtgtgtaaccccttttattttagctgagtgtgaatttttagattcaaattgtttgccatgtatttcttagtttgtaaatttgaaatgaagcaacataaacaacggtttctgcccggagaaggtcatgccagtcaggaccctgcgcattgatggtcatcttcaggtgattaacgttgatagatatctgagcagagaatagtgcaggatggagaaggagccacccacagacagggtttagcacattcagagtagactcaccaggctaatgctcatgggcccgctctggtttcatttagggctgagagactgattatatgaatggacaatggccagaccctatatgaaaacagaaccctgacccacaacctgcagcaacccgcccaggaaactgactccttattctcaataaagaacccagaaagctagcctgccatgagttagacttgtaacaagtcagattgcaatctccagtaaccatctaggaagctaaacaataacttcaacaattgacctcaagtggccaggacttgatcaataactggcagcttccctaattttgtgtccccatttttaacttaggatgaacgagagacagccaaataacacacccctaacaaatcagacaggatgccccacttcctgttagaccacctacagcttccctgcacccataacctttaattagggcacatctgaaaccttcctttttttcaggataaagctttcccacttctcttcctgcctttgtgtctccgccaaaatgcaagtgacagtgtggctgactccctgcctctagcaagctcagaataaatagcctttgcttgttctcatttggttggtctttgtttatttccagagggcctagttgggcaagaaatgatattgtccaggagcacgttttaatttcatggtctctgtaggtaggtgattccatgtagctgttgttccttcaggtacattagcatttcctagctttggggtgggggctgtggctgacctgtgagagatgcagccttgctcccacttgctgttccacgtgtggaaagggcagagcagtaaagcacattgctaaatgtcaacgcatgcattaggtattaccatctcacggtgaaccccattcacatggcgcccagtagggaggagcagaggggcctctttgcaacagagatcaatggccaacagcttttctttttttaaaatgtaaaactataaaggaaaaccttttcaaacattatcctcaaaagatttggaaataggagatctgagattagtgggtcactgaagggctagcacttgcttatagatgacttagcttagaaactccaacttcctcatacttttgtttctgctgataatagaatgcagtacaacaggagtgaaaaacaaagccaaattatttctttatctttttctaatgaaaattcaatgacatttcagcagtgacttcttcccaaaccttaaggagtacatataagcgttaagatgagaagttgaccaattgcctaagaacagtttgaagcatatcacaccttattttgttattatatttggtttctactacgtagagttcattatctgtgttctctctgttattactatatttgagaattgtaattatggagctttaataggatgaaagaaaagaaggatgcaaaaatacttaaatactgttcatgatgaaagatctacattattttcaaattatcttttattttattagctgagtttttagggtcctatggcaatatactagagtccaagtattttttcaaagtaatttaattttatgttgttatgattaggtaagtctactgaattgaatcaatttataggaaaagtatgagattagtattattaaatttcatactgtagtctggtttgctttaatatacctatatatgtatgtgtgtgtttatttaagactttagttgtgaaatatagactcctgttagtaactgatgccttttccttttctctttgattagaagaaatacattagaaaggtatcagaatcaactcatttgccagttggcaaacattcctggaattttaagaattgtaacaacaataaaacaataactgtttattaagtgcttactatgtgcactgtccttagtgctttacttctgttattttaagtgttagattatttatagagatcacagtaataatcctttcattgtttatgcacgcacatttgcaatgtaaatttgctgtctgccccacctccttctgtgagggaagtctattttccccttctctgaatctggtctggccctttgactttctatggtgaataaactgtggtgaaggtgatattttgcaagacaaggccttgggagacactgctgctttctctctcagcttcttggaacccagagctgggatgaatgaccatggagggaagaggctcagccacagaactagcacaaccccttgatatgcaagcgaggccatcttgaacaagccaggtccagctgagctaacagatggctacaggcaagacccaaaccaaatggtaccccacagaattataaaccaagcaaatgtttgttttttaaaatttttttttattattttatcgttaattgtagtaaaatacacagaacataaaatttaccatgttaactatttttaagcgtacaattcagcagtattaagtatattcacattgttgtacgattaatctccaaaacgttttcatcttgtagaactgaaactctatacccagtaaacaacaacttctgtttctccctcctgccattccctcacaattaccattttactttctgtttctgtgagcttgactattctagatacctcctcatacaagtgaaatcatgctatatctttatgtgactggcttatttcattaaggataatgtccctcaagttttatccatgttgtagcatatatcagaatatccacctttgtgaggctgaataatatccactataggtatatgtcacttttttttcatccattcatctgtcagtggacacttgtgttgcctttatccaaatggctgttgtaaataatgctgctaaaaacatgggtgtgcagatatctctttgagaccctgctttagattcttgtggatattcccagaagtggaattgccagattatatggtaattctattttttaactttttgaagtgttgttgttttaagccattcataactgaggtgatttgttctgtgtgatagctgaaacacctaactgaattttgacaacaaggcttcgaggtagtttctaccattctcatttttcaagggagaaacttcacttacccaaggtcgtatggtttggacaaacagaaccaggctttgataccatgaagtctggtaccagaacctcactctgcggcacactgtaccactttacagaaagcatgttcagaattgttttacctatagtggttgacgctggacagaaagaaacatcagtaaccaacaatattgaaaagatccctatctatgactgatgtagttcaaggaagtatacttttccagagtttgtagtatttatccattgtatggtggcctctgagcttatttctgtgttgtcagctaggcttaccctggtggtgttggagggaatagtactggatgatctacagggaggtccactcaccccactccagggctgctgggtccagatgggcaaattgggttcgaacaaagggccttgccagagtgggctggaatccagagcccatctggattccactcaggtgggaccaagcctgtgctctggccatctgggagtaaggggtcctttttctaatggatcctccccggaaaggctcctttgtgcaattcatctgaccggagaaggtcctctccttaagtccttcctcttccctcagatagcggggctgttgttgaactgtatcacagctccctgtcctccccatcaccaagtccctgccccttagtgctggatgactgttgtttctcctccatcagggtaacctgtgttgttgaagaagccaccagaaaaaactgtggttgagcaataatgaactcttgacttgagcgttaaagcggggccccagtggtttgcaggagccggtcaagtagagatagaccgagatggagatgagccactgtcagctgagtgtgtaatccaggaggctgtctttacacagtcctgggctttgaagttggagcaactcctggctttaccacctaggaaccatgtgactttggacactgtacttaacctcatcaagtctctgagacacaggtacatgagaaatgcctgccttacaggactgctataggctcaaaaaacaaagtctctaaagggactggaagagaatctattaaatagtcaatgttcgatacatgttcattgttaccacacccattcttcctcattacttccttcacctcctcccaaattcttctacagtaataataatattactattacaactattatcattaaaaccagaggccagtttagttagatttggtggtatctgatatgattcacattaagagagttataatgaagacctgcttgtgattgcaaaggttcacttgcaaagggataggatgaatgggatgtggattagcagcagcattataaaaaactttacaagtttcagttgagaataatctaacatgcttcgacctaaagaagcatacaagtaagcccaaaaacaaggagtagggaagggcatccaccaaccacaaggccaagggaaggcctaggtatctctacaggacagtgaagaattgtgacctatagtttaatccaccacaaagggcatgcactggtatggttggacagtttttaaagcatttatccatcctaaatgggcagtcccaatgcttgattagtagtgccagtgtaatgcctattgttaagtattttgagtagcatcctcattgctaagaacttcatctacagtatatcatttactctttttctttctgcattagtctttatattagatacttatctatgtatttatgtttatttaaataaacttaggggtacaagtgcaattttgttacatggatatattacagtagtggtgaagtctgggaggaaataccatttacttttaacaacaaccatatactttttgtatatataaagcacagatacatgtgcagtatacaaacagatacacagtatatctgtgatattaaaattttatgtgggggagcaattagaaaaaatgtctaaaaagtgtccttagagggacgataatgaaaacatttaagaattactggcaattgatatttttattaaataaatgtgaaaatataggttgagaggttaaataattagtccaagaacataaaattattaggtgtgagagctctgacttatacccaggtttgtgcgataatgaagtgtgtgcttttatccaccttaccaccttgcttccttgcccttcattcagctctctgaacctctgcttccctccatgtgctttactgcttcccatcctcccagatttctctgtaccctcccccggtagtggcctagattctcctaaactgctctgtcccccttctaggatctgagatcccacctctttggtttcattgttagtgaaggaatgcttcaagggaaatttctgctcttgggttggaggaatgagtgtttgcattttaatgcccattcagagacatttctcaaaggactgagtcttttccagtgggacttcaggatctctcacatgccagtgggaagcaatttggaactgtgtgctttgcaaacccgtgcaaatcatagcaggaaggccgatgcctatctctagctaaagccttatgtgctatatatcttcatgtgaatgtctggacaagaatcccctgctcttatgccataacctgggctctacacctgaatttctccatgtagcaattccaagaaaattcaatcttcaaaacacattttttagtaaatagaggcagccatgagaaacattttgttgttgctctgaaaagttgttgttttataaaatggaatagtcaatctcagctttctaaacagagtttctaggatcaatttatcaggaatgagtggattcctttctcttcctcccaaagggtctatggaagatgaagaatacaagcaataatagcaaatcaatcaaatttacattgcaaagagtccttcacaaaagtacctgagagggctctacctagataatcagatgctaacattacctttttcccaaatatagtccacctctgcaaagaaccaaggagtgtgggcttcagcttctctacagagtcgctggtggttaaactcaaagtagcagggcctcacatttgggcactgctgtgtaggaggtgccaagagtcagtcactcagctgatggcctctggtttccaaaggaaaaacaaaaactgttcagagctattgttcaaaaaggaaaaaaggattactccccaaattttagcacccaaaagcatacatgtgagtgtcaagtgctaacatttgcccaagtcaggtctggtggctcatgcctgtaatcccagcactttgggaggctgagacaggaggatcgcttgagcccaaaagttcaagtctagcctgggcagtatggtgagaacccatctctacaaaaaattaaaactattagccacgcgtggtggtgcctgcctgtagtccaagctacttgggcagctaaggtgggaggatcacctgagcctgagagatcgaggctgcagtgatccatgatggtgccactgcactccagcctgggcaacagagcaagatcctgtctcaaaataaataagtaaaataaaatacaataaaatttgcctacattgaatgcctacaaaagccaaggttatttcttaggttatttctctcatttgatataatggataaattcattcaaatgcctcagtttccctatctttaaattgggaatcataggaatacccacctgcaatagtttactagggctatggtaacaaggtgccacaaactgggtgacttaaatgagaaacttactgtgtcacaattctacagactaggcatccgagatcgaagtgtcacagcactgttttctttctcagggctcctggctgtgtgctgggaatctttggtgttcctgatctctgccttcatcttcacatggtgttctcccctgtgtatgcctgtgtcccgtttccccttttaacaatggtaccagtcatgttgggacagggacccatcctactccagtgtgacctcattttgttttttgtttgtttgtttgtttgtttttagacagagtcccactctgttgcccaggctggagtgcaaggatgtgatctcggctcactgcaacctctgcctcccaggctgaagcgactctcttgcctcagccaccatgcctggctaattttttgcgtatttttaatagagacagggtttcgccatgttggccaggctagtcccgaacccctgacctcaggtgatccgcccgcctcggcctcccaaagtgctaggattacaagcctgagctaccgcacccgaccaacctaattttaatataacaaattatatctacaatggccctacttctaaataaggtcagactctgaggtattggggtttaggatttcaacatacgagttttggaagaatacaattcaacccatgacaccacctcacatggtttggtgtggattaaatgagtacaaaaattgctatgtgagggtttgctctaattattattagtaagtagatgtcttaaaggataacaacataagcaatgattactacttgagaacctactaagtgtcagatactatattgtcaaaaacttctaatcctcgtagaaaccttcaaagtgtgttttttatctccagtatcttcagtttacaaatgggtaatctgaagcttagagaggtgaaaagattttgatgtacctgaggcttcacaacttgtttatgattataaacaagactataatctctacttgatggtgaaactctttgaataatggaagaaggttttaaaaattcatacctccttactttagtttttgtgtgcaaatgcaatcttccgtataatgtattgagtttgcataatcaaggttctaaaataattttttagataggaagcttagctatggataaaaactgccaattcaacagataaaagatagtcattttgatcttgtcaataattactttaagacagtggcaggtacctgatttagttaacattcagtgaacagagtccctgaacctgtgctaggaatcccagtccaataaaaccttgctcctgccttcaaagagctcacagttagtttagagagtgtgctaaggggataggccacggggccaggcaagattcacggggccacggtgaggaagattcaggtttatgatgcgggtgtgaaataacttacttgggatcaatgaatcattgaagaattctgttttttatattctccccacccaggcaagagtgcagtggcacaatctttgcttactgcaacatctgtctcttgggttcaagggattctcctgcctcagcctcccaggtagctgggactacagatgcccgccaccacgccgggctaatttttgtgttttcagtaaaggcagtgtttcactgggttggccaggctgatctgaaactcctgacctcaagtgattcacccgccttggcctcaaaatgctgggattacatacgcctggtgtggaattctttaatgcagtgagaggagatgaaggccactttagctaagcctttaggttcattgaagaggccattcaaaaagatgaaaggtttgacatatacttccctatatcaagccatgcctgatttttcagaaataaggtagaagtttaatggatgtcatagtctaaaaatttgtaaggtaatcactataaatggagggaaaaaaacccagttattttctcttagggccatttctcatgggaattcagactagaataaaaggaagttatttataggatgtttaatacccagtccctcaccaggattctagatagaaaaaaaatatttctggagatggaaacgctggtttcagtgtcatgtggaaagttttgttaaacacctatcatgtgcaaaaaatgaatatcttctcgatttagaagagcatatagtctagcagaggaagatagatacttcaaactctccacctcacttgcctggatatgaaatacttcctgcttttgaatgaattacattgatgttgattaatgataatggaataacattactttgcatttggaggatgcttttaacatttcaaagtgctttccgaattatttctcctgtcaaactgtccaacaagcctggtgtggatgggggctgggctgacactggcactggcacagggcccccaggagcctgtcctagctgctacttttctggcaatgcctttcccttgcaatttcttcccagcccgcaccttctaccttttctctctagttcccacactgtgcttcctttgttttggtcttcctggctattgccttggattctctacatatcctgccgtgctctttgaagcaaagctattacagaaatgtaataaataataaatttcatcactcagacagatcaataaaatgcatgataagaagaggccattatggagagtgaaaaatgcgcaagaggatgcccacagcatgagtcaatctttagccaggagatgccaaataccaggcaggccattacggggtattttaagcttttatttgttagtacatccacagacatttgttgagggtatttttcccgctatgcccagggctaggcactggacattccgagacatactgtgtccagaagctcaacaatttagctgaggagatggatgatgcagccataactaattgtaatgcagtgccattgcctctgtagacaataggcagagagcagtgagagttcagagggggaaggaaccagctttggagaggaggggagagggggcttttattaaagcgaggaaattggacttcaattatacagtaagagcaggatttttctcaggtggaagagttgaagtaggtgtgagatagattattttcctcgggcaggaaatatcacatgcaaatatgatggatcctatacttactgacaacgtctagggattttttttggttcacaatttttattcaggtatttaaagtctttctcaatctgggacagtttagataagcagccttacttttccactaagcctgtttcccactaacctttttttttttttttttttaactgtttaaaaggataaggcccagtaagatagaagtgagcacaaaagcaaggggctgctgggctccattggcatagaatataggcagagtgggcttgggccaccagctgtctcctggggttctcaggcctggagtcctgggggagcctcttgtccttttcgcttctctagcctccttgaaggaagaatctgaagggagtgatccagccttattatcatcctggtcacatggagagaaaagatagaagggtgatgctctttcttctaacaccctagtttttgaatatatggcccaagtcagcatccttgaacttgaccagtcagtgacaatactcctcttccgtggaggaagggggaaggatgtggagagaggatgtattaatccattgtgcattgctataaaggaatacctgaagttaagttatttataataaaaaaaaagttttattttggctcgtgattttgcagagtgtacaggaaacaatggtgccagtgtgtgcttttggtcaggacctcaggaagattttactcatggcagaaggcaaagggggagcaggtgtgtcacatggtgagagagggagcaaggggggaagggagaagatgccagactctttaaacaaacagctcttgcatgaacaaacagagcaggaactcactcattactgcaagggaggcaccaagccattcacgagagatcttcccccgtgacccagcacctcccactaggtctacctccaacatcagggatcacatttcaacatgagatttggaggggacaaacatccaaactatatcagaggagcactgaattatatggtacggaaacatcaacttccaaccacaactttgttatgaaattggatacagggctgagataagatgcaaagaaggccctaggctaatagaagtttagtctgttacctccttaatctttttcttctgaattatcctcattcatttactctttattctcacctcccaggcacaatgctttagcctcttttgcatttctgccttttcctattaaggtagccattgataaattaattctggaaaaggagtatgcactttggagtcagaggtgggttcaaatccaagaactattactaacttagcctcatgaccttgaaaaagttgctaggaaaattaaataagataacataggtataatacacagtacagtgtcttgctgtacaagcattcaataaatggcatatatacatatattcactgttagtttttcactagtgatgtggtatgctggaaagaataaaatatgtagtatgatgttttacgtagaactgcttaaaaatgcctgtctcttctcctctttcaggtctctataaagtttctaacttgttttactttttaccagcaattctgtctcacttcctggcagacttatatttagttctctaatgctgaacacaaactgctaactgtccagccaaatccattctcttgttcccctttagtctgatcatgtcttctccatttctcagcctttttatagttaagtgtggccatcagactaagtgttcatgggtatggaatgtaagtagaagtgatgtgtgccatttccagtcttggccattaacttcctacaagcaattctctgtgttcttatcttccttccagacacctgggatggggatgcccggagcaatcttggaagccagtcagctgatctgtccctcagctgagtccctgaatgactgttgagccaattgcctcccacaacatacagatacatttgtgagcaggcacgtgcacacacacagaaacaaaacatttggaaataaactattgccttcaagccatttaatttggggtcattttgttctgtcagtttatcctaccttaatacccatttttatctatctccaagtttgactgagatcgctggaaaaacccaaattgtaaggtacttttgaaagagcactgaaccaaaagcagaactaggtttaagatacttttgcacctaacagctatataatctttttatttacctattcaacccttctctttcttactgaaaaaaaattataataatctctgtgacttagttgagctatttaacttcctggttaccaggttactcacttgcaaaatgtgtcatggaattattgtgcaaaattattaggatagtacatgtcataattttaaatttgtagagtcttctacagcttcactgtccaaaatagtagtcactagccatatgttgctattgagtacctttcttagtctgttttgtgttgctataaaggaatatataaaataggtaatttatacagaagaaaaggtatctttggctcgcaattctgatatctaggaaagttcaaggttgggcatctgatgaggcccacaaactgcttccactcatggtggaaagtgaagcagaaccagtgtgtgcagagatcacatagtgagagaggaagcaagagagaaaagtgggaagtgctaagctcccttaaacaaccagctctagcaggaatgaaaacagtgagaactcactcaccctttcccttccccaggaatggaattaatccattcatgagggattctcctccatgacccaaacacctcccattagtccccatctccaacactggagatgaaatttcaataagagatttggatgggacaaatatccaaactatagcagtacctgaaatgtggatagtctgaattaagatactctgtaagtgtaaaatacaaactgtatttcacaggtctagtacacaaaaagaatatcagatggttcattaaaatttaaaaatattgattacatgttgaaatgataatatcttgagtctagtgggttaataaaatacgttattaaaatgaattccctttttttcacttttagtgtgactaccagaaaatttaagattatgtgtgtgactcacattacatttctattggacagcctgctctagacataaagtattgtaatttagtgcaggcggatatcctctaatacttctgaatgtgagtcttgagtagtaggagttagaaagcaagatttctctaaatgggattgatcatccttactttgcagggctgtaattgggattaaaaatcatatatgcatagtgcctggtacatagaagtcactcagcaaatactagctgttgttctcccaccttttcctttcattccaaaagcagcttccacaatcacaggctatatggctttggatttttctcatttaggaagaaattattttgtttcctcttttaaattcattttttttaaggattggaagaacatttgtaatcacaaaaaaaagagtacactgaggaaaatgagataaaggaaaaccctgggggagaggagtgctggttcctagctgggatgagctagagttggggggaagatcttagcggtcactgcatgctgagtgcatcacgtctgtaacagagctgggagcaagtgttagggtgatgttgccagataccttcttttccttttttttaaaaaaatttactttaagttatgggatacatgtgtagaatgtgcaggtttgttacacaggtatacatgtggcatggtggtttggtgcacctatcaacccatcatctaggtattaagccctgcctgcattaggtatttgtcctaatgctctccctcccctttcccctcaccctgcaacaggccctggtgtgtgatgttcccctccctgtgtccatgtgttctccttgttcactcccacttatgagtgagaacatgttgtgtttggttttttgttcctgttttaggatgctgagaatgatggtttccagcttcatccaagtccctgcaaaggacatgatctcattcttttttatggctgcatagtattccatggtgtgtatgtaccacattttctttatccattccatcatcagtgggcatttgggttggttccaagaatttgctattgtaaatagtgctgcaataagcatacgtgtgcatatgtctttatagtagaatgatttataaatcttttggtatatacccagtaatgggattgctgggtcaaatggtatttcttgttctagatcattgaggaaccatcacactgccttgcacaatggttgaactaatttacattcccaccaacagtgtaaaagtgttcatatttctccacatcctctccagaatctcttgtttcctgactttttagtgatcgccattctgactggtgtgagttggtatctcattgtggttttgatttgcatttctctaatgaccatgataatgagctttttttcatatgtttttgaccacatacatgtcttcttttgagaagtgtcttttcatatccttcgcccactttttgatggggttgtctgtttttttcttgtaaatttgtttaagttccttgtagattctggatattagccctttgtcagatgggtagattgcaaaaattttctcccattctgtatgttgcctgttcactctgacatagtttgttttgccaggcagaagctctttagtttaattagatcccatttgtcaactttggcttttgttgccattgcttttgatgatttagtcatgaagtctttgcccatgcctatgtcctgaatggtactgcctaggttttcttctaggttttttatggtttggggttttacatttaagtctttaattcatcttgagttaatttttgtataaggcataaggaagtggtcaagtttctgttttctgcctatggctagctagttttcccagtacatttattaaataggaaatcctttccccattgcttgtttgtgtcaagtttgttgaagatcagatggttgtagatgtgtggtgttatttctgaggtctctgttctattcctttggtctattcgatttggtaccagtaccatgctgttttggttactgtagccttatagtatagtttgaagtcaggtagcatgatgcctccagctttgctctttttgcttaggattgtcttggctatacaggctcctttttgttccatatgaaatttaaagtagttttttctaattctgtgaagaaagtcaatggtagcttgatggggatggcattgaatctataaattactttgggcagtatggccattttcacaatattgattcttcctatccatgaacatggatttttttttcatttgtttgtgtcctttcttatttctttgagcagtggtttgtagttcttcttgaagaggtccttcttgttccttgtaagttatattcctagatattttattctctttgtagcaattgtgaatgggagtttattcatgatttggttctctgcttgtttattgttggtgtataggaatgctcgtgatttttgcacattgattttgtatcctgagaccttgctgaagttgcttatcagcgtaaggagtttttggggtgagatgatggggttttctaaatatacaatcatgtcatctgcaaacagagacaatttgtcttcctttcttcctatttgaatacactttatttctttttcttgcctaatttccctggccagaacttccaatactatattgaataggaatgatgagagagggcattcttgtcttgtgcccgttttgaaagagaatgcttccaggttttgtccattcagtatgatattggttatggatttgttataaatagcttttattgagatacgttccgtcaatacctagtttattgagagtttttaacatgaagtaatgttgaattttatcaatggcgttttctgcatctattgagataatcatgtggtttttgtcattggttctgtttatgtgatggaatacgtttattgattagcgcatgttgaaccatccttgtattccagggatgaagctgacttgatcacggtggataagttttttgacatgctactggatttgatttgccagtattttactgaggattttcacatcgatgttattcaggcatattggcctgaaattttctttttttgttgtgtctctgccagacacaggatgctggcctcataaaatgtattagggaggagtccctctttttcttttgtttggaatagcttcagaagcaatggtatcagctcctctttgtacctctgatagaattcctctgtggatccatctggtcctgggcttttttggttggtaggctattaattactgcctcaatttcagaacttgttattggtgtatttagagatttgacttcttcctggtttactcttgggagggtgtatgtgtccaggaatttatccatttcttctagattttctagtttatttgtatagaggtgtttataatattgtctgatggtagtttgcatttctgtgggatcagtgggatatcccctttatcatttttgattgtgtctatttgattcttctctcttttcttctttattagtctagctagtggtctatttttgttaatcttttcataaaaacaggtcctggattcattgatttttttgaagggttttttgtaggtctatctccttcagttctgctctgatcttagttatttcctgtcttctgctaggctttgaattcatttgcccttgcttctctagttcttttaattttgatgttagggtatagctttgaggcccttccagctttccaatgtgggcatttaatggtataaatttccctcttaatactactttacctgtgtcccagagattctggtacattgtttctttgttctcattggtttcaaagaacttcttaatttctgccttaattttattatttacccaggagtcattcagaagcaggttgttcactttccatgtagttgtgcagttttgagttctaatttgattgcattgtggttggagagactgttatgatttccattcttttgcttttgcttagaagagttttatttcaaattatgtggtcaattttagaataagtgccatgtggtgctgagaagaatgtatattctgctgatttggagtggagagttctatagttgtttgttaggtccacttgctccagagctgagttgaagtcctgaatattgttattaattttctgtgttgttgatctgtctaatattgacagtggggtgttaaagtctcttactattattgcatggaagtctaagtgtctttgtaagtctctaagaacttgctctatgaatctgggtgctcctatgttgggtgcatgtatatttaggatagttagcttttcttgttccattgatccctttaccattatgtaatgcccttctttgtcttttttgatctttgttggcttaaagcctgtttcttcatagactaggattgcaactcctgcttttttttgggctttccatttgcttggtaaatattcctgcatccctttattttgagcctatgtgtgtctttgcacgtaagattggtcttctggatacagcacaccaatgggtcttgagtctttatccaatttgccagtctgtgtcttttaactggggcacttggctcatttacttttaaggttagtatttttatgtgtgaatttgatcctgtcatcttgatgctagctggttattttgcacattagttgatgcagtttctttatagtgtcattggtttttatattttgatgtatttttgcaatggctggtaccgatttttcctttccatatttagtgcttccttcaggagctcttgatttggctgttgatacttgtgtatgcttcatgaagttctcatgctgtgtttttcagctccatcaggtcatttatgctcctctcaaaactggttattctagttaacagttcctgtaaccttttatcaaggtgcttagcttccttgcattgggttcgaacatgctcttttagctcagaggagtttgttattacccaccttctgaagcctacttctgtcaaatccatctcattctttgtccagttttgtacccttgctggagaggagttgtgaatatttagaggagaagtggaattgtggtttttggaattttcagcattttcgcactggtttttcctcatcttcatggatttatctacctttgatctttgaggctgatgacctttggatggggtttttgtgtgggggtcttttttgttgatgttgttgttgctttctgtttgttagtttttctttaacagtcaggcctctcttctgcaggtctgctgcagtttgctggaggtccactccagaacttgttcacctaggtattaccagtggaggctgcagaacagcaaagattgcttcttactccttcctctggaagctttgtcccagaggggcaccaggctaatgctagccggatctctcctgtatgaggtttctatcgacccctgtcaggaggtctctcacagtcaggagacacaggggtcagggacccacttgaggaggcagtctgtcctttagcagagctggtgcactgtgttgggaaaatcctccttgtcaggatcagctgttctctttagagccggcaggcaggagagattaagtccacagaaactgcggacttaaccacagccacccctccccctaagtgctctgtcccaggaagatgagagttgtatctgtaagcccctgactggggctgctgcatttccttcgaagatgtcttgcccagtgaggtggaatctagagaagcagtctggccacagctgctttgccatgctgtggtgaattcagcccagtccaaaccttccagtgcccttagcactgtcaggggaagacagcccactaaagcctcagtaatggccgatgcccctccccctagcaagctcaatggtcccaggttgactctggactgctgtgctggcagtgagaatttcaagccaatggttcttagcttgctgagctctgtgggagtgggacctgctgagtgagaacacctggctccctggcttcatccccctttccaggggagtggactgttctcctgtctcggtgggtttccagatgccactgggatacgaaaaaactcctgcagctagcttggtgtctgcccaaacagccgcccagttttgtgcctgaaacccagggccctggtggtgtaggctcaccagggaatctcctgatctgcggattgcaaaaatctgtgggaaaagcgtagtacccagggcaggtagcacagtccttcatggcttctcttggctgggcgagggaggtcctctggctccttgcatttcctgggtgaagtgaagccccaccctgcttctgctcactctctgtgggttgcacccactgcctaaccagacccattgagatgaactgggtacctcaactggaaatgcaggaatcaccctccttctgcactggtcttgctgggagctgcagaccagagctgttcctatttgaccatcttggtccctctctcgccagatgccctcttttaaaaattcttaaatgtatttgcagtatcaaagttgagactacttttcttctcctttacagccttttcaatatcaccatctccctaagtatgcagttacaagaggtaacttctctctgtatcttatctaaggaaactgagagcagttagcttctttggtatgaggaaaatgggttcaagtctagcagttcctatttaaagacctttccttagctaatgcttttctttaatcaaatcaccgccccttagattctaaaggaaacaaccattatcctaatttcaggaatgttttatttttctttgtttttggctgaagatccataattttgactgtctaatatgaagcaggtattttccaatacttctctctcagaaccaaatacttgttttctcctcatatctcctcttgtcttctctccttttccttcccttttacctcttccctcttctacccttttccttctttccctttttctttctctcccatttcctcctttccttcttccctctttcttttcctttgtttgttcacgtgacagaggtggaaagaggatgacacattaggaagactgagaaactatcccatttgtggccacctagaaaccagaagttactaagatctagcactaatcaatttcttctcaaagtaccgatttaccttgtattaacatggctttcaagatactctttagactagtgttcccctcttactttctgaatgaagactatttatgttttcacttgaggaggtgaccctgagagattagggtatatagtcataagttacttttttaaattatagctttatagagataaaattcacttactataacattcaccagtttgtagtatgcagttcaatgggttttaatatactcacagcgttgtgcaaacgtctccactctttaattgctttatttcttcaaccttctacaaactaagtatctattaatagacattttcctttgctttcttctcccagaaactgccaatctactttctgtctttataaatttacctactccagacatacattttctataagtggaataatataattgtgacttttgattttttattttaattttgtgattttgtgactgggcttttgtgactggcttctttcacttagcaaaatattttgaggttcattcatattatagcttgtatcaatacttcattctttttattgccacatatattccattctataaagttaccatatcttttttttctacttatcagttatagccgcttttaggatgtcattaataatgttgctatgaacatttatgtacaggttttgtgtatatatgtgtctttaattctcttgggtatatacttaggcttaaaagtgttgcatcatatggtatgtctatgtttaattgccaaactgttttcataagtggctgaatcattttacaatcctaccagaaatgtatgagggaaacaatttctcgacagccttgtcaacacttactattgtccatcttttttattttagcgatgtcagtgactatgaagtgtgtcttgtggttttgatttgcatttttctgttgattaataatgtttaacatcttttcatgtgtttattagccatttgtatataatctttggatgaatgcatattcacattctttgttcatttttgagttgtttgtcttttttaattgttgagttgtaagagtgctttgtatattctgtaatataagttccttatcagatatatgatttgcaagcattttcttccattttatgtttgtcttttcacttccttgatggtatcttttgaagcatgaattttaattttgatgaagcccactttatttatttatttatttgtgtcacttgtactttgggtgacagatctaaggaatcagagcctaatccttagaagtttctctcatgtctttaaaaacacatatacataaaataggatggtttgcaatttctaagcagttcttgtcaggcttcaatggcttccagacaaagttttggctgtgctagcaaagaagtgttaaaatcttattttcatagctagccggtggtgtgaggagggcacagctgctaggcatttggacactgcagcaattgctttaattggacattcctcacccctctagtctgacttgttaatggctttttaagtgagacacaccagccaagtgaattagactatttggcaagtcaattcctgctcacttggaagcgttaatccatggaaagtaagcagaggccttcagccaggaggaaacctgaatttcatttgcagaggtgaaagagaaagaactattgtctgcagtctcaggagtttccaagtacacttccaagggctgactggaagaaaggtcttcttatctaactggctctctctctctctcaaccccactttttcaattcagcacatatttatttttcccttcaacatggctatgaagcatacaagtgaggtctgtcgtggtgcctgccctgtgaagcatctatgcatgagaaacaggagaaaaatacacatacaaaataattagcaataatttgctaataatgtaatctattttctgttcactccttgacttagcatattctgacttcagtcaaccactctacttaaattgttctcttaaaaaacaatgacactcaccagtaacctcttaggtatcaaacttgatgattttcaaaatctgcatttgtagcttcgacctttcttctgggcttcatcctgaatttccccggcctgtcacacatctttacatagaaatcccagcagcacatctttcacacattgaaagtcaaacttctcctaccctttttttttatcgccttttccaccttcaacaatgtattctcctcctctgatcatggctaaacaactactttaattagcaaattctcccattatcacccgcatgtcactagttttagtccatttacgtgacttcctttctattcccactccttcgtgtaaactttctctttcctaaataatacaagttaaggcctcttccacacccaacttctctaatcctttgtctacattttggctagaatcatttttcaaaaccacaaactttatcctgccagttcttttttcacacatcttcagttattcttcagtgcctggagaataaggtcgaaatctttgagctgcttttgtagacctgctcattcttgcctcaacctctctttctagccttgtctcacatagcactaaacccttcactgttctctcctcacatcatggtcatctgtacatccactctctttcctctccctgaaataccctttcttttgactgtttggtaaactcttagtcattctataagttccccaatccaaagtgaacttggaaagtcttccttgagatccacggcaacttgcgtagacttctgttatgattcttatcatacttctttgtgcacaaatttttctcttgctccaatcccttactcttgtctcctctgatgcatttttcaatctcttgctcttgtttattcctttctcaaactctctctacaccatacctccatctataaaccgttctgctcctagataagcagggactgtcctgcctgtgcaccttgcttagtgcctcactcagaagatacgctccttaaagggcctaaggaaggaatttgctgaactaattatgattaaaactatgattaaatctcacccatctaaaggcaaacatgctcaggtttcaaattagtctgaagtgtggtttaaggggctttttaaatgtgacagtttttgttgttgttgttgatagatggtggggagcgttggtatggtgggaaaaaaaccagaaaaaccaaatgtgaggaatttagtgatgcagaattgctgatggagggccagaggccatccctggagtggctcatctgaccctgtatacgatgttcgtttggatgggtggctgtattgtaatagtcacttggacactggctttagaagtcagaagagatttgactcaaggcttttataatatgtctctttcatggtcatctgcctaacttatctgaacttcagaatctactactgttatataaatgacctccccccaaccttgagggttttgtgggaataaataggataatgcttatgttgtgtttagtcaagttctttcatgtggcaagcacttaccaagtgggagctatttcatgtttacgtttaaaaaagtgtgtatctgttatctaaccagcctgggaaaatacagatgatatttctattatattttaccagttcccttgaggatggcccccccttttttttttaaatttcttgggctggggaccaagctctcattcctgaatgctatgagtactgagagagatgtgctgtcaaagccaatgaacggcagttgtacacactgacattttttcagaatttgtccttgggggtatttaagcagcaatgtccaagactgtaaacacagctgagaaatgctgttattacatttaagaatctcttttctgtaatattaagacatcttgatttaattggtaagccgctctgtgatagcattcaatttaaatgaggtttgtcgagtggagaatcataaggcaatctctcatggaccaaggattgctgatgaggtctaccttattgccatgtgtcagaaattaaatcactgtctattatcatgaaccagtcaatcagattctctttttgattagaatgcactagtgggggaggtagagaagtgagaatttaaaagaattttaccacttccatattgtgttgcttacttcatggtattagaaatgctgttggctcactatactagaatattatcaaccagtattttcataggaaacaaaaatatagacatacacacatatatacactaaaagaatggaaatctgaaggaaatagagaggaaaatataattttgtctttaaaaaatcccagaagcccttagactcccatgattaggattatattcaacttatacattcttctgtgtcattcttccttcagtaaattaggaacaactaatatgctctgcctcctttctgaataaggaagtataaatggatgttactgaattccctcaagtcctgggcaaatacactatcacaatgtctttggtttgcatgaagatggaggcgctcatttataatgtgaagcctttcaccgttaaagcttcacgtgaacccgaactgacacagaatcaaagctttcatgagagcaagatggaaagagattatgtcaacacaccccatcccaaaatgttgtaaagtgccagacttcttagggtattccatgacactgctagaatgtttctcatattcagtcacgtagatcattcttttactatttgttttcttttagatgagttcaattggagcctgcccgctatggaaaattattgatgcaattacattaatcctgatcaccatggtgatgtatagttataaaattggcttaaaatactgtaaggcaggaaaactaggcaaccttaactcttttagcacaggtggccctctttgcagagcattctgactttcttagtttccaatattctagcagatggcatgggtagttgggcacaatcaattttcttgcattgcctcacatcttccagtgagattttgcggaagaatggtgtgtgcaccacagatcttgggatcattcaaaggattctcaaagctcctcaatggccaatcagcagtgaagagggaaatggtggtaaatgaggtagaagccctctgtgaatgaagtaatgttctggaaggggctatgcatttggattttcattctggtaattttctctatgaccttggaaaatgactttatttcttcgcttttgcagatggaatgaattataaaaatggttctgtgaaaccttgaaaccataaaatgctatacagatgctaaatatacagaatttagcacgcgattttcctctgttcttaggacagttactatttctagatccaagtggatcagggaagaatagtgctctaatgctctgagaaggaaacgagtgttaagctggatactggtgtgcttagctgcaattaaggaagctgctgtggaattagtgactcacccttcatcaggatggaaaaactgtctcatgccgtgtttttgatttctctcccctattcagtttgtttgaagtctcttttgtgataggagaaaatgacaattactctcctcttgtgtttccatttttggtaagcagtgggcagagtttacattggatgaaatttcaaaagctgtttttatgaaaaatcacttcctctgaacaatgggaaaatggtgagagagagacgatagttggcttttagtctaccaggttcaacctcctgcaaaagctgaattcaagactgccctataggcattgggaatctagttaatgccactatctgcctgtgaatttcctgccttaaactgtctcggattatacattaagctggttttttttcccctataatgtgtcagaaaacaaaaattcaacaaactgagcttacagatctaattggcttttattagtgattcatgaatccgttcgcatcccatctgtgaagcaacaagggcctcttcagggtgtggcagaagagtggttttcataaggcaacttgagcaggaacaatgaaacagcaagtgcaaaaaatgattggttaacatcatattacttcaggttactttccttgtataggctaaagcacaggaggcttccttatcatcctggttcagctagccttctgcgtggtttctgcaaatctctctctctctttttttttttttaaactggcccatttgtaagttcagtttgattatgtggcacctagcacaagtgacaccattctggtttggtctggtctgttagagccaggagcctagtccaaaacattggcatcccataaattttattcaatgaatgtttcctatacccctgtgtcaatttcatctcctacatgaatccatccccctccctttccctggccccttatactaactgagttgtttgcgcttgggaggaatacaaagtattttcaatacatggctagcatgaacaaattatagttaaatgatacattttgtagaaaaagcaatgcacactgaggtcatttgcctgcagatgttaaattatctgcttttttgtgttactatatatgctgtagcacttatccactggtgtaaataagaaagtcaattgaactctctctgtctggagagagagaaaatgagattgagaataaagtcttgcagaggttgcagatggccctgtaaggctgaattcagcccttgcgtatattttgttcagttggtacaaagttaaatttaaatgcagttaagtggctttcaaatgcactttgctacagtccccactgctccttagtgtcttatgccctatatgtttcactactttgttgcctacgtagtttctgaatgaacttgaacttgcaacccctcgtttaaaaacttgttcctgttatgaaactgtgggtgcttatgctaaggacttaatctttctctcttgcgtgggaggaaaggatatctataacagaacaataattgtaaactagaagagtagaaaaaaggatgaaagaaaagggcaatataaaaggcaggaaaagtaggggtataagaaaataaaataaagatcaaatacatttattactatgagagcttctatgcgggaaaaggaaaaacaaagtataataatacaaggcaaccacataattaaataattttttcaaaagactgtcagtggtaacacacacacacacacacacacacacaattaggaaaagctacaaaagagccccaagtctaacttggcaaaattgaaagtatgtgatagttttaaaataaaaattaaaatactttaaactagtttaaaaatatatctctacttcatgtacatctgcactgtttgacatgttataagaagtgctaaattatcttaataatttaagaagaaaagaaaagtaatggtcttccttctctctctccaattctaattccttggaatagtcgtttctaaatagattgcagatatgttcacttttcaacattgcttatataagagaaggcaaggtatttagaatttttcttgatcataacaaaaagacactgaaactcagaggcagcaagaggccccattatgggggcaaagagtagcagtggaaatgaaagtgagttcctgaacaagttgcttccaacagggtaggtgtattttgaagtggcgttgtaagtggcaccctactgcttccatgagtttaaattgtatcaactgaatataaagtataagccaattttaaaatgagaatttgtagaattcatgtgattagattagaggtttttaaaaagtaatatttgaattttgccaggggggtggggtggggtatgtattatgtgttcacgggatgacagcagatatcttcaaggaagtggtttggagtacattaagttctgaacacataaaatgactttttttttttttcctttttggtcttcaggagacttgagaaaacaagtgctgtgtaagttataaacaggatgaatggaatagtgatttcacaggagttagaaaaatactccagtcacaaaagttaaaattagagtaatctgaggcattctcagtactttggataccctgtccacattcagggctactgattatatttccaaagaaacttataaaaccagatgtctagctggcaattggttttgatgaatctccaaatctcagcaatgagaaaatttgacagttgtcagacagcagctagctattacgagtgagccagggaattttcttatctgttacaagtatagaaccattacagggagatactgcatcatagtgtcatgtttataaagaaggcttcagagcacatggtttaatccccaaatttctaagaatgacagttcattttcttggatgttgaaaggtgctttaatacctatacaacatgaagatggttttattatcaccaatcaaaatgtcttggtatttcttaatttaaacaaattcattttataggaattacattgctgagaattcacaccatgacactgacgggacttataatagtggttctaaagcctgcatgtgcgtcagaataatttggggatttgaggtgacttgttaaatgtacagtcactgggtagccccctgtaagattctgatttagtacatttggggtggaatccaggcatctacatttttaaaaagcaccatggccaattctgaatcatggtcgggtttgaaaagcactaagtttgggcaggcctgatttatttcaaagaattttcaagcatatttagttgtgccgttcagtaatagtagcttctcttattactgtgtgtatcccagtaaatctcttccccatttactctttcatcgccccactttgggttcttctgctctgccgccatctatttggcctgtacccactgttcactaatgaaagcccgtagcttctaaaatgggccaagattcacagttgatataagctgagaaagactgacaagttattctgccgaatgatactggaaaaaagaataggatagagggctaatgatgttattttatttttgtccggtatctttacacccttagttgctttttcatttgtcaaatggaatctcatgtggaatctcgctctataaagcagatgaaaaaatgtggacccagtctggctgccagtcctgcccacttggtttccctctgactcagacactggtatcccaggcccctttgtctcatgtgcccctgaaaactgctgtgacatttaagcttttgtgtctcacataaaggcaataagcatattgcaaggttttcttttcttcaggtttcaatactctaacagatatgttctcaaagtagaattagtccttggttaaaatgagtcacatgtaatctaaagtgtttttcctcataaacccatctccagcttttatggtgaaattcaattgtaaaataagatgaggtgttaagtttaatttttttgaagaagacgttcattccataaatatttatcaagcactctctagttatgacataattcagtttctaacgtacagtacacctcttacaaaattgcataatctttaaactgaaaggccaaatatcttcatcaaatactgcttcttcagatctttgcttcctcagctctttaaagaaatgggcacctttggcatggatgggtttatatccagatgataattccagagccatcagggtttcagtttttgctggcaaagaaatcaattttattgctactcgaaggctcccctgggatgaagcaatattggaggaggcaatgcattctagaatgtcaactttcagaggtttggagtttgctcaaaaaataaatgatctctgacttgattaaacttcttttgagttcctactatatataagggcctgtggaagggctgggtaccccggcattgtaagatgtgactgcagccctcaaggggtttgcagtctagctggaaagaaggatctggcaataagaaagcacagtgagcccaaatgaagtgttcagattccacatactacatacagaatgcatcatgtaattgaagaaatagaaatcaccaggttacatggcagacctaaaaaaattcagcaagtctttttgaatgtacttgtgactgtcaacatttacattgtccaaaattttcttgtcaggtgagggcatcaaagaactcttaaacgctttcaaatgtggtgggagcatcttgcttctgtgagaagatttatattctccctaccttctcaattctgtttccctatcttatatgctataaacaaaacctcgctcacgaaaataaaagatgaatgcatgttctgaaagaatacagaatcatgacagctgaaatggtcatggtttcttttaggagatgaaaaaattaaatacacaggtgaaaacattagaatgcaattctctaggttaccatatgcttacaaaaaatcaaaaggagctgcagaaatggaaatttctaatgacagaagaaatcaaacagcagatacagtagagactttagagataaatgggtgtcaatagtggtaagaacacaggttcagaggagatccaatgttccatctaaatcctggttctgtcactgagtgggaatgattacttgatctttctgtgtcctcgtttcatgtgacaatatctatcacatgcagtgttgggtaaaacacttagcataatgcctggcacccagtcaatgtgcaataaatgttggctattatcatcatcaccacctccatcatcatcattctctaataaaagttaagcccttctctctgttgaatacacccatcagttaataccagtggctccttttaaatagcttaaaagcaaccaacattctatagatttcagtggggaagattgtaagtgaaatgggtgttgtgacctttcttgaaaataacccttctctctattagtatataaatgctagtgctgagtacacatactctgaagttgaacttaattaatttggggcagtagcattttcactgttgatgagcttgtatttattttctttggtttacaaagcagctggtgttgtccaaaaatttagaaacccctttccaaaatttaaatgacccccttcattcccttcatttacactgttgttctagaacctgggatgacactctgcagggtgaatggagactggtccctctgtcttcttttccatctctcttgctttagttttgctttcttcttcttctttttctttttctttttctgactgaagcatggaataactggctggtgttcattgagctaatttccttacctgcttcagggcctttgaacccaaagacctgtaggtgatctgtgactatggcaagcaggaagccttggggaccactcttcacatttggagtaatcctggtttgaaaatgtgtgagggaagccaggcaggcagagagcactatgtggctgctgagttagaaaatgctgaaatggaaagatgctggaatagaaaatcaaatgccatttattcattggcctacactttcactagtaccttcctggcagccttaagcgtattctttgtggtggtggccttttgaatgtcaatctgtggaaggacttctgtttttagcaaaggctgatctttaaggcaattaggtaacagttaaagtaatagtccccagttattgaacacttgctatgtacagggtactgtgctcagcactttccactatttcattcaatcacaacaacagccctatgagatagggtattattatcatcagtttgtagttgaggaaattgaggttaagggataagtgacttccccaaggtcacaggaagtaagtcgtggagatgagatatgaacctagcctttctgatttcaaagcttgtgctgttaaccactttgctatacttcctcatgtgtgtttaatagggtccagtttctactgaaaggatattttaattttgtgataaaacaggacaggcctaaaaaattaggtgcagactctgaataaatttaatatatctacccatctctcttattcctcttaagctcactttaaaaaatctctttttaaaaggaggttttctttttaaacctaacaataaaccaaggacatccgtccaagttaataaatatgtgccttttttaaaaaatagaaaaaagtctaattgacaagtaaaaattgtatatatttatagtgtacaatgtgaggttttgatacacacacacacacacacacacacacacacacacacacgctgtgaaatggccaaatcaagcttattaacatattattaactcaggagtttattctttatattatattcttaaaatctaattgctttgctatttttaagtatatagtgttattattaactattatcttcatgatgcacagtaggccacttgaatgtgttcttcctatccaaatgaagtttagcccccctccccacttcaagtatctgtcttttaatggctacataatatagtttggatacattatattcaattagccttttgttgatttggatatgccataatctactcaagcattcctttattgatgggctttcaagttacttccagtttgttgtcagttaagtaaattgtttacttgaaagcttccattgtctgggtctctaccactatgggacccattttgagtgttggtgatgctcacacaacaaggagacacaagcccggagttgagctcctaggtgagagagccatccagtagccattctggtccaagtcctgtccctaccacttacctgccacgtgcctctgcacaagccatctggcctcttttaagtctcagtttcttcataagaaaaatgagaaaaacagtgctgctctcaaagaatgaccatgaggacaaacagaataatgtgcatgcagggctgagcacagaacctggcatgaagcaggtgccaaacagcagagcaactgcattgctggaacccagcagaaacatcctctcactggagcttggatgggagctctctgagggccctaactcccctcttttggcctaatgcattatagggactccgtaaacatttgttaaccaaaaaatgtttggaaaactactactgttctgagcggtatttttcgtttcctttctatatttttattctaacagtcactaaaccacattttgagagtatctggaatggagaacctccagtggtttaaatagttttaccaaggaaatgtttttcacgcggaaagaagactgagatgaaacttatagagaccttgcctcaccctttcatttgccgaaaccatgtatttttgaatctagtgtctgagctcttaaccactaagtcatattgctttaataatgatgatgtgataataggtaccatttattgagcacttactgtgtcccagaaaaatgtgctcagcacgctttaccaatgatcccttaatcatcacagtaatcctgagagaaatataccctcattgtctccatattctatttggggaaatggaggcttaaaaagatttaccaaattttcccaggttagtggaaccagtactccaacccagctctgcctgacaccagtgccactgtgctaattccatggcaggctgtggtgactatgtatttattggactctgttcatatggaaagttgtatgcatacagaaacaggaacatttgctgtaatacttaagggagtgaaagaggaatgtacagaaggctaaaagaggtgagtattgctttgtcaattctaatgtctttctatgatgttgatatttggatcatctaagtaagtgctatgatgaaaataatattcaagaggctggtctggctgtctgtagaatgaggtagatgtagtgaaagctggaatggaggaaagcagctaagaagctattgtagtcgttagacattgaagtaaggaaatgtggaggagaaagatggcagtggaattagagacaaattgacaaacaagcgggtagtaattagaccttcatccaatcacttgtggggagtggggagcatggttcatcatccttcaggatggatctgtccctggagattggaaacatgcacgcacacatttcttacttccacgttcaaaactatggtgagcattcacagctggtatttcacaacctcttggattcatgtttattatatcctggatgaagaagcacttcctttcatctgaggctcactgggcccagggttgtgtggtgacctaaaggccgtatctatgaggattttgtctaagagtacctcaggtaagggctctcaggaacagcttcttagctgagccaccatgctccagatttgatctttaatcttatgactatagagaatgaatattttcaggtgactcagttcagtctctacctcatgaaaattaaattgaaaaaacaatatagagattatagttcaagtcctctgctactgtttaactgtgtaaacttgggtgaatgatttaatctctgtcagcttcagtttcctcatattagcatgggatggtccttgtaagatactatgttggttaaatgggcccacgcatgcaaagcacctatagtgcttgggacactgccaatacctaataaatattatatgctaatatttttatgattgaactataaatcataactaccttatgtaatatttttttatatgggtatcaagtctaaaacctccatatcaagagctttctgagccctttttgtcacctcgtctttcccctaccccaattcttgtgttgaggttattgggaaactgcactgttaatcagaaggtagctcagttaagtgtggactcaacgaagaaagaagatcattgagatgtgtaatattgaagacctgggaaagtgacaaaatatttatatcctacaatagcagaagcctttatgtcaatggaattgatttggtttctcagctccactgtctcattcttttggagacttctgggtaaacacattttgctcctctgaacactgtatttctcgaatgttcctccctggcagtcgccatgttctttctgtgaatttgttagaatcacttattaaaccaaagtcagggtcaccccttgtggggcttagaagtgcttttttttttttaagccttttatctgttgatgagctttcgtttctgaatatgaatggtatttggtcaaggtaggaagaggtttgaactagaacaacaactaaaaggcactggatggacaaatcatatttaaatgtaacggctgtaatcagggaagttgaaatagggagataagagaggttatccaaagttctgtgttggttggataagacattcaccgttattattttgtacaatatacagaaacaattgtctactcatacagctggaaggagccatggagattacctctattccccacattttacagatgaggaaacttctcagcgagtagataatagcctgaaattctattacttagagcaagcagggaaagtgttaggagggagttggggttagctctaggcagccacatcagcataatagtagtggcttcaatttttcttcatattgcactgaattcatttgtagtaatgaacctatctgtctatctatattatagtcatcaaattatcttcagtaactatgtaggtgttattagtttaaacctttaagacccatgaaaatacttgggttcaccaagcacgtctgccatatgcacttaaggagattcttcactgaatagtaattgtagtaactgctgccctgctcttgtaatatcttctataaaaataataatttgcacttcaaatgtctctttctgtgaggtgctcggcgtaccttgcaggaatcgcttacctaaatctatccttcaaggtggtgtatggaatagcttccagtggagtagctcagtaggaggagggaagagtgctgagaattcctagaatgcaaacctaaacctgggtttgttcagacataatccttagttatcacattagaataacaccttatattttcaaagctctttcatacttattgaattaatagagccattaaacctctctgaaatagtagtagtggatagtgtgacaggtgattaaaaccagatggagaagccttttttgaccctaacaacaccaaactgattagtgataaagccatacttcaagatgcttgactgtaactctagtgctcttttttttttttttttaactagattatattagctagagatttttcttgataagacagtggtacttttaaggcctttattcctctggattacaaaaaagtaagttacctattcctgattatatgaagcaagttaactgtttcaggaacatcaagagacctttaccacatcacaataaaactcaaggtcattttgctccaggagtacttatacaggtgatatttgacggtagtacatatcttgaagagaaaaaaagtcattttggctagggtaagcacagctaaagtttgacacggcagcttcaatgaatcatgcctctttttatggcacaattaaattttttgagaccaactgtgattttatcagctatccaggtcatctgtaggcaggtcatgattgttacatggggtggtgataattggtacaaggtcatgccctaagcatgttatagactagtagcccagcattgctaatcattttaaatcaagactacaaaattcaactgtagcatttcacttcagagcaaaaacattgcatttgcttgttcatgttgctatttcccttcccctccatgtctttctctccccaattctctcaatttgataggctgtaagaagcttcgtacccaccaaatgcaaccatatttcccctcagctctttattacaaacatgcacttttatcaaaaattttttaaaagactgaaaatgagactcagaatcttttatttatcacagaatggaccctggctcagctgcttattgactgcgtaaccttgtttgaatcagtttccgtacttagaaaataaggaaagtaatacttgcctcatagagtaattgtaaggattaaatgaatatataaaatctcaagcttagggtctagaacgtagtattttttcataaatgtaagtctctgtgtttctcaaatagttgtgtgcataggtatcacctacattgcttgtgaaagcttcagattcttgtgctcattcccgctccctaaggattttggtgcataggactggttaggacctaggaatctgcagctgcacaggtagatggtctgaggattatagttagaagtgccatgctgtaggttcaaagcaaatgggctgtataacacattcttcataaatttctgggttatggtcaaatttcctacgtttttcagagaaagaaattatagtgttcagggggcacttaactggaaataggtagcaacagaaaactggatgttgttgaatttatttattaattcaccgtatgttattgggcaccttctctttggcaaactttcccatagctgcagggaacacagtgataaacgaggtagagatggaggcagagcactaagtgagtaactccttttcctgggagcccagggctctattacccagggtatgctgtcttcagcataaggatgactctatcaagtaggtctgtagatacttccaagtctttactgccgaaactctcgcccttgccctagaaaggtgttgggtctcaaagggagttgtctcagaggaagggcaacctgcagcctttattttattgggaccagacccagcatccctggctcagattcagatttactgttcttatcatcagatgtggaataaaggcttctggaacagcagatgtggttttctacctatgaaagtaacattctctaaagcctagaggatggaacttgatctctagggataaaagagcaacagttgctcttaggatcttgtctaacaattggcttagtaggtgctaactccaattctcatctacctgctccatcttgattttagccacccatctaagcttccacttgccaccctttctgtgattatgccagccaccgactgtgctctctttggtccctcttggggcagagacaatccagaatgttgggaattacctgaactctcatctcatttgtctctccagccatgtgttaggctctgtggccacccacaatctcaggcccagctgttctgtaggaccagccctaagtggcccagagaaatattttctttgggttatatccagtaaaaggatatgcggatatgctcgggtcttgttgagaggcagcctggtaaatggagtgaaaacactagaagcaggcaatgccaatgtgaagtccctctgctccagccagcttcccaaccttggccaagtgcccactttctcaggagtatcccacctcccttccagaccagaaatgccgtagggcttgacagccaatttgcgctctctttcctacatcctgacctctttgactcaggtcccggaacttttgatccgcaattatgaatctcaatatacaaccccttgatcatgaccccttgcctcatggaactctctgtctcctctgtctagcccctgctaagcttcgtggactttgtcactaatctacttcacctatggtcttgctaagttgcttcctctgtcacctcccttcccagcccactcgagctctgtcctgccactgtccaaagtcaaaagaggcagaactaccttccttactttattttctttctcctctactttgctctttctttctctttaccagaacagagcatctgcaaccactctcactgcatttttttaccacgttttcttcagagtctatctgaaaatgaaatacagatttttttgataaatatattttcatactgaggttgaataagaatctgatctttatgattcttagacttgaaaaaatatatattttctgaaggaagtagactgttatcttcattatcacctccgtaaaattgcaaatggtcaaaaccataaaaaatggctttgctctatgtgtaataggcaaatgaagggaattcatggcaactgaaacccttgctttaaagtcagctctttgtgaatggaaagcagctgatattctgtaaatcctccccagatagggtttcttacagaaatactggcagactctctaatgactgtgactgctttgatatgaggatgtggtcaatatctcaagaaaaaagactgcaactttctaccttctgcagtatagagaagagaaaaggaagtatatgatgttctcacatccatctaactgagcaaccaaaatgctttataattttttaattgatttgtctggaaagagtccgttccctataggactcacagatctccatttatgtagggaagaaaattgtagtcctatccccatggctgcttgaaattccattattgatgtgatgagctctttgttcctcattttgatacagataagatattgaactgaagaaaatgcacaaaatatatctttctccactaataaaccgagaagtggtagtggtgccgtttgttaatttgggatttattttgctttgccaaatggatttgccattaatttcactaaggccacacaaaactctacatcagtgacatgcagaaatagaggtgagattgtccagtaagtagttgccagaatttgtcttgatgatgcttgatgcagatttaagagagagaaagcagatgcagtgtgtttcactggggtgccagagccagggggactgagactgccacaatgtgtgggacctttcctttctgagcacagcctggtggcagtcagcctttccctccagcccccacacaaaacaagtcggtcaagccatgcacgagtgatcttgatttgaagagagagaaagaaatttgatccccaagtctcagagctgaggtacttatgcactgaactccaagaggcatttcatttctaactagcttagaatttcccacagtttgacagcaacccaaataaagaaaatacttgaggaagcaaagtagatgtgctggaagttgagggcattacctgatggctgaatgaatttgacaggcttttctcctgttgttttgacacaattgtattttcctctacaccgctgatggagtgctctgcctaaccacgatgtacccaccttccgtggctcagctgagggccactttgtcaaatatctccatcttactcattcctcgccgtggccctctcccaccagggacctcccagatcactctgtcacccccaagactacacatttcggcactttatgccgccttgtcttaccctttttttcatgttttattgctgcatggcatttaatgttattactacagcaaaactgtatttccctagagggagggaatttgacttgttctggtctcaaactctaaactccggtcagttgtgaagaagcctggaaccaaatttgcagcccatctccaggaaagtgtatataattgtgtggtggatactgtgggtcatgaccctactcacggctctatctaattgtttcttctccctcttcccccttcctccttgttgtcagtcttttctaagtttctttcaatccttttagggattgtatggagtataaataaccttccatatgctaagccagaagttaccaacatgggtgtttcctgacgccaggcaagtaatgtaatataatgactcagccaagggaagagggcagggcttatctctgcacagctgcagtcacttgtggccatgctggaatgagggccctttgttgccaaattttcagatttttcaagagaagttagaaatacagagtcttaggcaaacttcacaatatttaaacatagacagctaaagtatgggaatatccttggtgattcccctaacctggaaaacatatttgggtgccatattcagtttgtgcaccaccggtttgcacaacctgctttaaagtttcatttggtaggtatccagttataatggaactgactctcctactgtggctttcttagtataaggccacatgccatgtgctgatcagcaaacgctgttgaaggattttgaaaagactggaaaaaagaaaactggttgtctagttatctgaagaccctgggctgtgtcacatccactatgaatacaccctccaaaatctgagaccttgttaatgagccctgtcttctctcccagattctaactgctcttcagcgttgtgacttagaggggatgccgtaatgcatgtgtgcctggaacccagggaggcagaggtcctctttttcaccctaatgtgaagcatgaagttagaatcatctctgtgctccctaatagagcctcatgcagagctgttatcattctggataagggattcatgggcatttgcatccataccccccaaatagtggttcctgagaaaatttctctgacatgctgagaaaaaataaagaattcataaagttgaaattattgaacttattttgatattaatgtacttttttactctggttgtcccaaaatatctcattgggtatatttacttgacaaaatgaaaagttggcaactggccaggcacggtggctcacatctgtaatcctagcactttgggaggccaaagctggtggatcccctgaggtcaggagttcaagaccagcttggccaacatggtgaaatcccgactctgctaaaagtataaaaataagccaggcatggtggcaggtgcctgtaatcccagctactcaggacgctgaggcaggagaattgcttgaacctgggaggcggaggttgcagtgagccgagatcgcaccactgcactccagcctaggtgacaagagtgaaactctgtctcaaaaaaaaaaaaaaaaaaaaaaaaaagttggcaaccttagaacagttcctgtcatctctctttattgtttcatttctaaaagagtttcatttggttgctacccagttataatgaaactgaaatccacagtggtctgtgaaatccaagtctgtggccagatttgagccacaccctcagttaatgacagggccgggagagggagggaagggtggaaatgaccaggaacaccaggtacagatagaaaatgtccatcctcagtaagacgggtcacctctgtgaggggtacgtgtcctcattcagtccatactcaaaagagatgtatccaaaagctgttgtaagcagctcaggttttgggggcaggggctgaccttttctagtctttgaaagataatgtattactcttgagaaatgtagaattttattgtcagtgtgcttgaattcagcaaacagacccggagatgaacccaagggacaacgggctcaaagaacatagatgataccatggaactttgacctatttcatatgagcattcctgggcctgcatttgggactggctgccttgtttgttttataaattgatcctcatattgattccttacttgatggctgtggaaaagaagtctccttcttgtttgaactcatgtctttgtgagctgcctttatgcttattacataaaagtctccctgattcttgttgatttggcaagagacttccttgctgagaattttgcgggctgtggtatgggtgtaaagtggtttgctgtaatggaacagcttccagaagagaatccggtctccgttttgaaatgccacttcttggaaccagaagaatttattctaggagggagaaaagaattattgataagttcataattattcacaattatttattgagtacccactctataccaggttgtattttagacactagggctatagtaaccactaagcaaaatgcacagaaatgcttgtcttcagtggtcctatgctttattgggacaaaacagatcagaaacaaaataaaactcacaacatataagaacattacatagtatgtgagaaggagacaattctatctggaaagtctagcagagcaagtgtgatcaagagtttacaagaagggattgctgtttaaaccagggaagtcagattaggtgtccttgattaagtgatagttgagtgacagtgacaactttatttatgctttagaaagactactctggctgctttgggaaaagactgctgaaaagcatggagacctgtcaggaacccattgcaaaagtccttgcaggcagcttggagcagggtggtggcagtagaggtggtgagaagaggttagatttgggatgtatttcaaaagcagagccaatgtggatttccaataaactggaccttttaataaagctgagagagactttacagatcatttagaccccttccgaggccaagtaggtagcacaagggagtgaaactagctgcatgacaatagaggctcttagaaacagggtgcattgtcttattacattaaaaaaattaaagccgggcgcggtggctcacgcctgtaatcccagcactttgggagggtgaggtgggtggatcatgaggtcaagagattgagatcatcctggccaatatggtgaaatcccaactctactaaaaatacaaaaatcagctgggtgtggtggtgggcgcctgtagtcccagctacttcggaggctgaggcaggagaatcgcttgaacccaggtcgaggttgcagtgagccgagatcgcgccactgcatttcagcctgggtgacagggcaagactcagtctcggaaaaaaaaaaaaaaaaaaaaattaaaacaccgttcaagccaaattatatctgtaaagtcagcctatgaacttctaaactacatcctgtaagaatcaaacccattctttttacagatgagagatacggggtcttacaaagtttattgacttctccaaggtcattagaggcagaatcagaatcgaagcctcaggcttcctcatttgtagttcagagttcattcattccatctgtactcgaaccatgaacagcttttcctccttggtgctgctctgagtggatgccacccatgtagaatattcttttattttcccactggtgtagcgtgatgggtccattttatttttctcttcatctctatcatcaggtgtcatcttttaaaacttgtgagcccttggctgtcccagccacccccaaagaacacccttgggatttactgattggctcacaacagtaattgtgagcaatgaaagaataggctaacttagcctcctccctagtttggttgatcacagcagagagaggaagactaacaaagaaggcctatataaaatgggaactgagggctatcttttgcttttggcgtcttgatggatgcctaaggtggatcagtatttgtgtaacataacaggggtactttacctgtggggagaggagtgaccactgaaaacactgttcaaaggggtcattcatagtcgtgcatttataaatttttttaaaaatagctttcttttcctattataaaagacatgtatcttggtatatagaataatttgatatatttgataaagaaggtattgcctgggaaaggatgttgagaagattagctatccaggggaacattaagttgtattttcattttacattgttgacagaaataaaaaccttcatggattaaaatttaaacagaaaatacttttaaaaactctaaggaaatttaaccaatatttatatagagaaagcttttgaaactttaaaagcaatgaaaaaaataggaaaaaaaaacaagtaagatttatcacatgaaaattaaaacacaaacccagaaaaatattcacaataaatagtgaataaaaagttaacaaccttaatgtgcaaagttatctttttcttggataaaaatcccatggcatcaaatagagctgagaggaagagctcacagttcatgaaagaggaaatacaaatatggcaagtaaacttccaagaaaaggtggaacttcctagtaatcaaagaagacaagttaaactaaaatgaaaaccatttttttttgtttgtcagattggtaaaggttaaataaaatttttaatacgtaaagtcagcaagttaagacagcagacctgtttacatatgcctggtattaacataacgtggcatatcggtctgaaaagcaatatggcaacatgcactgagagccttaagatgctgatattcatcaatccatgaatctcacttttggtagcaatctaaatatccgctcgtaagatgtataagtaatttttgctatagttatgttatggaatgatgtatctggaagtttatttccctccacacatactctgtgccactcctgtgctttatgggagtctattgttaaaaatctcactgcttcatccagtggtaacatgttttatggcccacaggtgagagtcccatttatcacagaaactttggagtatacataaaactaaaagagagaaaaagaccagccataatcacaacattcgaagtcagcatagctaatattttcatattttcctttctaatctttgcaaagtacattcatagttcaagagagttttgcttaggtgtcatctctcaataataaaaacttctcaaactatggatcaattatgcatatgtgcacctgtgggtacattatacatttatatatgattatatataagcaagtttatgtcctattagtctctgaacctttccatcacatcttaaatttttaaagtttttataaaaattctaatttacccttttaaatacatacctgctgtgtgacgggatgttagagaacccaactctgtatctattttaacagcatggtggcttatagcaagcatgggcaatcttttatgactttgcccccaatctctcccaatctcctgtaattcaggcatttcactttgctcaaccttatctctgatcagcctcctcacccattactcatcatttcacatcaggaatccacaagtaagcaattcaagaaccttgaatggaacatgagtgaaagctatttctgcagcctaaaccccttcaatcaatacaagaatgtcagcaattctagagtctaaacttattaaattctcatattatttttaaaatgctagccccagtcctctttgtctgatttctaatctctgaaagaaacagtaaatgcaaacataggtattttaaagagatagggtggaggggggtgcttttccagggtactctcttatcattttcctgacaaacttatgtgatttaacagttactggtaaaacctttcaccaacagtttgttactgtgacagcagaagcactcaaattcagggaatgtcgaacttcatcttgtgaattcagacctggcagaagaccatttcttcactagaagttggaaaaatgtcactctctgagactgcaataaatggagcccagggttctgctttgtgtactgagtgagagaataatagtgtggtgtccctgtagacagagaagctgactatgctctacggagacagtgttttccaagatgtgttaagtgcaattccagcttctcggcttttgatagatgttcctctagaaatgttcattgctcaaaggcatttaggaaaagattcattgcaggactttaatatgctaaggtgcaatatgaatcaataagcacaagttgtagcacacaacatttaaacctgtatgagcatgaaacccttcttcaagggagactagtgttttccaaggcctgctttgggaaattcttcattgggcactttgcttatgtagcagatttgaatcttagtctgtaaactcagatatgcaataaatagaacatttcacatttttgaaatattaaactctgattttgatgtccccatccctcccaggtggcaggaagcttaactttggcccttcttggagttctgcactgacctgttagtaccatgccaaaattctggtcattgcttatctgtcacacttggctagttgccccttgactcagacagggcccaggatccatcctaaggtcttccctcaggatgcttcctgggcaataattgagtctctactggtggggatggggtgtaatctttttttctgtttgccttcctgattctctctccctgtactccaaaagtcttcctgagtatacctagcattaggttttactgttttattttcttaattgatggctagtatttaagaacattatctcccttctgtattatgtattttaaataagagtatttactgtcttgtatatacttgtattgtcttgtatatacttgtcttgtaagagcatttactgtcttgtatatctgaatgggtcacatgtagtgcaagcttcaagactggtttgattcagcggttcaacagtgtcatcaaagtactcgtttcattcttccttaatgttttgtgactgtgatatgacattgaatctgagatctattcctttatgaaggggaaatagctagcatttccaggttttatatttgcaacccacatcttccagtagagagacacaatggctttggacaacttttcagaatgttaaacaatccttctctcgtaatagcttccatcaaacctctactaacatcttattgaccttcattgcatcacataagttaaaattattctgaaatattttatatatgtactatatatatatataacatttaagatatatgaagaaaaatataatgcgatttcatagcccccttttaaacttccttagcaatgcctcctatatcccctgacaggggcaacgtttctttgtgtttatcaatattttgctttcctgtataattttaccctttatgtatacaatcctaaacaatatattttttagtgttgcatgattttagattttgtgataatgatatcatctatgtgtatttcttctgccacttgcctttttgattccacatgatttgtgagattcatccatgctggtggatgaatctatttcttaatttgtactgtgatatagtattccattgtgtgattaagccacagtttacttatctatgtgttgttgataaactgttaagtcggctctagtttgggagtgttaggagtaatgttgccaatcttctcttatacattgttgtgcctgcatggaaggggtgcccaaatgtacatacatatataagaatggcattgccgaatgaaaccatgaacagtctttaatgttactatataatgcaaaattattttccaaaatagaataatattttcaatataagtagaatataagaactcctgtttttccacatctttgccaacacttggttttgtcagcatttaaaaaagttgtcaaattggtgtgtatgaatttatactttacagttcaatttaccattttggcaaatcaattaggctgagaatatttgcatttttaattgatatttttatttcatcttttgtgaaatgtctgtttatgatttttacccattttgattttgtgttgttttcaccttcttaatggatttgtagaagttcttgtatgttctgcttactaatccagggtcagttatacatgttgcaatatcttctcccaatttgcaatgtacattttcactttttgagataaattcttttaataaactaaaaaaataaggtggtcaaattatcaaactattccttatggttgatattttgttgtcttatttttaaaattattttctactccaacctcatatatatttgtgtatgcctatgtgtgtgtgtgtatttacatatgggcttatatatttgggcaatgtggtactgatatatttgggcagtgtggtactgacacaaagacagaccaatgagacacaatggaaagcccagaaatgaatccatgcatatatgtaaatttggtagatgacattacagataactgggaaaagataagtggaaacaattaatttctatattcaaaaaatagatggaataagaccccctccttcataacaggtcaattaaagacatatatgtatatgtttatgtgtatatatatatatatatatatatatatatatatatatatacacacacacatatgtttatgtgtatatatatatatatatatatacacacacacacacacacacacacatttctacatatgtagctgtatatacacgaatatacacatatatgtctttaacttaacgtgaaggaggagtcttatttcatctgtgttttaatatggctaataattgtctcagcatcatttacgtttcccaataatctgtaatggtatctctgtcatctaccaaatttccccatatgcctggatttatttctgggctgtctgtggtgtgcctttggtctgttgtctttgagtcagtaccatattgccactagcttctatacatttacaatgagctttaagtctggttacacaagtctcctcccacattctcacgcctagaccttattcttcaggaatgtcttggtcattcttggccttttgcatttctacagaaattttataataatcttggagatttttaatatttttatgaaatttcattaaatttatagttttggggaagagttggtatctttgtaacattataatgttgagtctttctatctatatttctatccaaatctacttatttagatcttcactgtctttcgtcactataataaatggtatctttcagtatcatgtattctcattattgctaggcattctttttttttttttttgagatggagtctcgctctgtcatcccaggctggagtgcagtggcgcgatctcggctcactgcaagctccgcctcccgggttcacgccattctcctgcctcagcctcccgagtagctgggactacaggggcccgccaccatgcccagctaattttttgtatttttagtagagacggggtttcaccgtgttagacaggatggtctcaatctcctgacctggtgatccgcccatctcggcctcccaaagtactgggattataggctgctaggcattcttttttttaatggatttcagtgtttaaagaattcaagaagagcctttgatatctggttacctctactttttgaggaaaccaaatccctgatgcagagaatgaaagagtttgtctatctgcttgaacggagaagaaaagaaaaataaacagaaaatgttgcaatttgaaagtaattttagtaaatttgcctgccacacctacataatcttatttaatcctcaccacaacgttcgaagttaggtgttatttgtcctattttcatgacaagggaaaccaaggtttaggaaagccaagtaatttactcaaagtcacagagcgaatgtgtttatggtaaagccaggatttaaaatcaggtggatttcacaccaaaatagttctgttcatcgcgtagtactttccctcgggcaagaagaatgttcacaattttctaagcatttgagtacaatgaccggaatggataatcctttctgtagacaattatgtggctctgtctcccctcactaaggtcagcagacatttgatacaactttatccatctcttcttgtcactgttgctggctgagggggccacttggctcccagggaggagattttgcacacctgaggaaacagacagcagacagcaccaacatgcttcccctagactgcatttggacacacacagccaggcaggggaactgaaattgtagagcagcagtctgtgtggagtcattttaatgttttcttaaacagtcagtgatggaaaactttgataacaactcaagtgaaagcttatggctgcgaaaagcctcctctgtggatctgactggaaaggattctctgctgaatatggcttagatgcctgagccccgtgttctttggtaagaaaattaccgcaagtcattcgccatctgtgatcctcaggggtggaatcttttgctggaagacacagttattatcaatcaacctgtgctagccaacaggcctccagagcttcgcgggtggggggaatgttgttacagaagaaacgggaaagaggagcctttgtgggaaagggtggttagtattcttgatggcttgtcagaggcagtagtggccataatcacgtgagtgcagcacttgagctggttcagagctgcagtgcctggagtcgtgtctgccggcagctgccggaggcggaagtggcgtccatggtagccacttcgtcaggagggctcctcaggttttagagccagagcacaactgtgactcctataccaggcacactggacctcaggagccttgctggagtctcctcagaattcacaaaagaaatatgaagaattaggaagaaagttaaaacttagtagagatcctctttatagatgcaacttgagaaacagcgcacagatataggttactcgactggaggagttctgtgtttgtgttttcctattataaagagttcgggagaaagtggggtgcttgctaaccattggttctctctcctgtctctctcctgtcttttctctcatcttgccctttctcttttgccattgccccttttctcatttttcgttctcttatttgttctttccttctccctccacttctccttcgccttttctctcttgcttctttctctgcttcacttcattctccctgttctgtcctctcttccagtcgcccttttttccaacccaccctttgctatgttctgaattagtgattgcctaagtggaaagatggagacagtttcagaaatcctatttattttagttcatcagttgttactgcttactttttgtttgaatatatttggggtatattctcaaaaatatgttgataatggagtacagaaattctggtgactgttactctccaatgtctctcttttcttcctagaactaactactagtcctttccagttcgggtagatggattatatttcttgcatagtactttcagcatttatcatttttggtaaatgaatacctaatgtgccgctagggaagctaaattcatacctatttcagctggggtgagcactgtgaccttctgttacacatacctattgctgccaccagagacagaagattgagttggatgcactatgggtagagacaagggctggtgctacttacttatcagaaaggattcttgtaagaattaaatgaaataatgggcatagaatttagaattaaataatgttatgtgcatggtatgctacaaagatttggattcagacctctttacaaatctcagattcgtcatttactagcatgcaaacttgggcaagtcactttattctacttgaaccttttcttttctataaaatgaggtcaataaataatattcatttacaaattgatcatcaaggcaaatgagataatacatgaaatctcctaaaatagagtagatgctcactgaatatcaccttacttccctccacccaactatgcatttatttatctgtcaaacatttatattatgctcactttatgccatgcactgttctaagagctttataaatttaactcttcaatatcatcatagtcttttgagtacttactattactatctcgttttgcagattggtaagctgaagcaaaggaggtttaataacttgtttaaagcctcatggatagtaagtagcagagccactaactgatatttttgtgccgacaccttaattcaagcttttttctcctttaactgaagatattattgccctgagatattaccttgaaatcgatatagatttttttcttgagtttgcaaattttctctcttagaaggcctgaggaaaaaataacattaaacaaatgcacacttaattatgagttcattttctgtgttaatgtagtaaagaggtgaatgaatgtcataaaatatactctcatttggttccaccctgagagagccgttggattgcagccccagtgcttttcagcagggaagctggccagagatgcctgcagcctgctggggagtgtgtgggtagctcctccagcagtgtgcctgcactcctcatctgcacagagcatgcacagtgttcaaaggcacacagatggggactcaagtggggccaagatcactgggaagagtgtcggaaaatgaaacctggccaacagacagcacccttctgtttaatcagaatgctggagccaggtccagagaataatgactacaaactggctgtgccttgggcctattcagcatcttgttctcattttcaagtgtttggtccttgggaaggtctcaaagttcactttgctactcgattatgctgcctattgaggaattttcaaggcaaagtgaattcatgtgacctggattcattattatttaagattattaacacatttttagaccgaattggcagtaaggaaagggaggaaggaaacatctattgaggtcataccaggtgctgggtgctgtagtgggcacttctatgcatgttagctcaactgacgataccagagaagtggaaattacttcagattgtcatgaaaaagacaaatggagaaggtgggatgcatgaaaaatagacttttaaaattcctaaatcaatgccctcaagtcatctaaaatgattagaaacagtctatagttgtcttttatgaggagacaagaattatatgtgttccttgtttttttctccttctgcttgctgaagagttctggtttcacttgtctagtccttttccttccctttgtcctgccttgagagactggttatattaagcttttgtgaggaatttcaggtgagagggaatggaggaagaaaaaagagacttagggacacatattcatacccatgtgtgtatgtgtatttatgtgatatatgtataattttatatatgtgataaatacatacacattacaaatgcaattatactatacttaatctttcatatgttttaaatccttcaagtttattatgaacatctccccatgtcaacacatttaaaaccacagtatcattattaatattgcctaaaactctatactcagtatatgtcaatacttgattattggatatttaggtagtttccagttttagttttatcaatagtgcagcagtgacatctgaacaaagtcatttaaaatggcaccagttactgtttctcagggatcagctttattgtgatttttcttaaattagaggaatcgcctatatgttcaaactaattttttagattactagaaatattcttgtaacaatgtcttatggagaacccactgtataaaacccatagaagtgtacttccccagccagatgcagtggctcacacttgtaatcccagcactttgggaggccaaggcaggtggatcacttgaggtcaggagttccagaccagcctggccaacatggtgacatcccatctctactaaaaaaaaaaaaaaattcaaaaattagttgggcctggtggcacacacctgtaatcccagctacttgggaggctgaggcagaagaattgcttgagcccgggaggtggaggttgcagtaagctgagatcaagatcacgccactgcactccagcctgggcgacagagctagactgcctcaaaaagaaaaaaaaaagtggtactttcctccatgggttgcctcctgcccctgaacgcccccatccctcagtgacctctgagcttccacagtacccaagagtgctccggaacaatggtaagaccactgagctaggaactagctttgttttgtttgtttgtttgtttctatattattatttgttgatgttacagagtatagaaaattggctttttttctttaaaagaagaaactatgttttctttttttaaaacaactcacattgagctttgctatactactttgttacctgaattggtaatggttttctttttttctatgttataatagaatctttatatttaaataaacttaaatactttcaggcgctgtggtctagagctcactgaaagtgttatgtgtacatgagcaggaccctcaagagccaacctgtgttttttgtctcattaacttggaggaaggcatgaggggtcagggcctacaatatcacttggaaacaaggaatataaagaaaatctggcctgtttggtaaaactgtgcttctccatgtcttgcctcttttgatctcttgcctaagttttgttttgaaaggttaacactattcatcttgtcatgactttaaataatcagattacttttctatgcaacaatgctctgtttttcctaagtttcctatttcttcagtgattctggggtgggatggagagtgaatagaaatacaggcatcaactttagtgttttcattgcaattgttttatttgtgcccctcaagttgaacctctctgaatgagtgtgatcatatatctcacatacttggtgttttttcttcagatgttgggattcaaattgtttggaaatttcacatgttgtaaacctaacttagtgacatcatgtgaccatgtataagggaacctttatcattatgttattaggaacctgatctctttgtcattcatctattttttgccctggcttgttgggattggatcaaaccaatggaaatgccggagaactgagttagaaatgcataggatgttaaaagaacagaaatttatgctttaaagtattactactattagatttgtaagtttaattttttttcctctggtgttaaataaattgctcaaagatctctgacaccagaaggaaattagaaggtaaatgtatgttgataacacagaaggatcagagagggaaatccactagcaaataaaagaaaataggaagagtaagtaagtacatcattgtaagcaaaaactgacaaaaaggaaagtttgaagccagaaacagtcaaaaagttcttctaaaagtaagaaaatgtttatgaggggcacattggacatattttctattctattggggtctggagagataggcaagtatgaatgaacaggtggaatttagttgttttccaaaacttgaacaaacaagaaagggtattttggggtccaattagcaacattaagataaattttatatactggcttcctgggatttgtgccttcaatttacaagttttgctgataaagaagaaaatcaattttattttattctatttcccagggagatagcaaaatgcttgaggattttttttgcaagagactttttaattaggactattatagaaatgagttaaacagccaaatatcaaacctgaaacgatctcctgaggcaagagtgtacatgatcattaggtttggaggcaaactattgttaaggattctcatataaggtatcttagtctccacaagcaaaggtgatcaaatccagttgaacttgcttcacaccatatgccattgtccttcagtcccccaagcagacaaatcaagcttgattacatatgagataccaaggcatccagagaaatgatagtgggtgtaagtcatgccacaatagggtgtggataggtgtttctggatacggagatagatggccacacaatcctgctgccttcacccagccagctctcagcttaagagaggtaggaaatgaggcaaggaaaggaagatctgagcccttcctggagctcagctgcatcctgaggcagatgtttaatggactagaaatgatcacatagagaattccttgtgtctaacctagaactaaagcctgtgagaacacactcttaatttatttccatactgaagccctaaccagaagcttagatctttgcattccaacataagaaagagacaggggttaccaaactaatctgtgagaagtaaaagaatgtgtgaaaaaaataacatgagccccagagtctagagcagaagtggataagatgaccttacctatagtcttctaagctgagacaacaggaggccaggcccctggtcgggaggatggtgtgtgtgtgtgtgtgtgtgtgtgtacatgtgtgtgtaatgtgacttacccattaggcaccataggtgcggtgccttggggccgtggcagttttagggctccacaaaaatgttttaatcttttttaaaatcaagaataaaaaatgaatctaataaaaataatgaatatttattaatgaattcagcatagattatataaacttgccttatgccaatgtagtcctaaaatatgttttcatatttttttctatagaggaaggtactcatgagggcagaagtgactagggccaaaaaagtcattgtgcagctctgacagattgaatgaccatgagagagacacagaatgacaacctcctgatagatagatgcagagagattggcagagaggaacagagacagaacagcgagaaacagatacaggaagatacatgcagagtgagaaacagggacagagagacagagggagatgaaaacagacacacatgcccacacacaaagagagaaacaggcagacacacacccccgcgccccctcccccatctggacccgccccaccaacatcctgacagatacaggaaggcagagagaatgagacagatggagacacaggaaagacatgcagaactagactgacagccataggctaagatgtcacagggaacattctactggaaggaggcagccatcagcttggtcttacttgtttcagcctcccaggatcaaatatgtctgaagagtaacaggcctttccatccactctttatttttagccacagaggaaacagtaagagagaagagggcagatgcttctgtttaccaggattttaattggctacctttggagcctgtgggcctaagctatgactattgtctagaagctttgggagaaaggtaaaaccacagtgtaaaatcacagtggaagcttggagctgaaatgattattgtatcttctctaaccttatacccagtaatgatgtgtttgtaaggccagtggtccaattttttctgcagagtgaacaaaccagtggctcccccactacctccatagagatgttttaacacagacacattctaaacagcaaactacatcggacgccagtctcctataaatgctagagagtaggcctcctcctggcctttatttttccatgttcctggatatatgagagtctcaagagggaggtttgatgccaacccctgcccttgaccttgggcaaccttcttcccctttgtgggtggaatgaggtgccatgacttgttgcttttattcacaaagtgcctcacttgtttatatgaagccaccggcctcatggccatgcctcagccaaaccaactgggaattatgaagattggtttgaggcaggaagtgtcctggctctagacctaggacagctgctttgattgtgagtgcaccaggaaagtgggacaattgaagcatgaggaccttgtcatttaattgaaagtcacagagttccttttcacctgtgtcatctctggaaaactggagagagatgatctatacaagacccagtaagatacacaccatttaaaatgccctacaagaagtcacagtgaaatgaaataatttacaccaaaaggtgtatgttcttcaatcttctctgaattctggacttctgatcttgccagagatagttgttagaagaaattgatgataacttttttaaaaagaaacaagttttaaaactagaactagctcagccttcccttcattcaaggttggataagcagtagtcagtgagaacttgggaaaatagtcttgaagaggaactgtgttcacatgtccttagtcatgaaaatcatttttaggtgaagtgatttctcattttgcacaaatgattatagagtgtgtctgtttgtgaacttggtcataattgctgcccaacatcattatggcgataatttgtttagctaagagaataagagcagttgaagttatttttaagtttgcattttgtcagttgtaggttttcttttttcttcctttttttttttttttttgcatttgatggcaccagctgagtgtgggatggtgcacaaatcccctcagaaatggagttatttggtcacagtaaactgaagcctctccccaaccgccaagataacagcaattactttggattcattttagtaggtgtgaaaagctcatctgtttaaaagatgagtactctggtttatataggatcctctggtagcagcaggttaattaaagaatgattctatcatccctagcctaaatcgcaggcattataaaagccagcctgctttatgactgtcatgtgagaaatgtgcacactgataccccagaatttgagcattgttaaaagttagtccattgggtgtgtttgttcttcacattatccagagcatctgccagtttcttctttcttgattatatgcacctttgcaaacaatagtacagttagcaacactcttctaagtgtgccacatttaatttggggtgagaatacagctttaattccattttacagatgaagaaatggaggcacaaagttgttaagtacctttgtccaaggtcctagagtttgtgagcagcagaaggggtttagcaatcagcctgccttgggagccatgtgcttattacctacaattcactgcccaactgagaagtagcatgggagatcacctctcccactcatctttgagatgctgattcattatttgactaagaggccagactcttctgcttaccaggattttaattggctacctttggagcctgtgggcctaaggtatgactgttgtctagaagctttgggagaaaggtgaaatcactgtaaaatcacagcggaagcttggtgctgaaatgattattgtatcttctccaaccttatacccagtaacgatgtgtttgtaagtccaattttgtgtttgtggtccaattttttcctgcagagtgaaaaaaataatggctcccccaccaccttgatatggatgttttaacactacacattctagacagcaaactacatcagagaccagtctcctcatccctggaggcatcacactgtgtgctgggctctggacaaagtaactagaagtataagttctaagcagtcctcaccactaagtaacttgtggtataagagagggaatggcacacataattgtcaagtcaacccttactgcaaagaagttcagatgggtggtgcaagcagtaactgctgtggaagctcagatgaggaagaaaacaggtctggctgaatggtatgggtctccaagaagagggcaggatgtgtgcttgtctgagtttggggataagattcaattttattctaaaaaaaattgcacttggatgaatagagagaagaacatgccatgtgcagagatgtgagcaggactctgtgaatgtaaaacacaggtgatggtcagagtcagatgggagagctctattttgggagtcctggatgagaggctgaaaagatacccaccgacccatgctctattatagcgagcagaaaaatgaacacattgtggtttgctcatttcatatatgaaagtgtggggctcaaaaatctgattactgtgtatgtcacgtagaaccacacttccccctccaaagtacgtctcatgccattgtatattcacatcttgtctaagaagaaactgtatctctaagtgccataaactccaataaaagcaggtttgttctttcctcccacttgtgttcctgaaacctatgtttataggaccttatgttacttacactttggtgtgttacctttaatctcaacctctatttgctacaaacaccactgaaaggtgacagtttcatgtgggataaactctattgatctctgtctgtaaggcaagatgtttttctcaagcatttttgggcacattttctctgagaggtagcatagggcagtggtcatgagcatagatggaagtcagactgtctgggttctgatcccagccctggcacttattgctaggcaacctatggtatgtacttaacttctctgtgcttccgattactcatgtttttaaagattaaattcaggcaccatgctttaagaagcacctggcacatagtatggaatagttagcttacatcatgggttcccagcaggggtgatagcaccctcaagggggcaaaaagtttaaattcaggaatggtttcattaggaaaacatttgcttagtgaggcttcttgtggggctgaggggtaagagggatgagtggagaggaaaaaagtggtccagaaacccctgggttgcaccaaccccattaagttggacctgatgaagcattgatagaaggaatcccaaaagaggtttacatgttgtacttggaggcccgtaaccaatagagggtttaatcaacaggctttttacctagggcctgatgtaggctccgccttaaggccatcacattcactgcttggttatgtgcacagggagggaaccagtggaagcccaaccccccttccacagggttcttgaagctagtcatgaagggaacagagggaggagggaatgagttgctttgcctgccttgcctgaggtggaaatggctgtgatagatgtggtgtgacctgggcagagtgaatagtaaaagttcacatctacccaggattttctgtttttcagagtagtttcacactcattatctcacaagcactctttctcttttgaaatagtttttagttacacatgtagtaaagaaatgcattcctttgtaagaaattgaagtattactgataaaagtaaaaatgccccatgagccacatctggttccagttccctgctccctccacaggattaacccctgttagcactgtgtgtgtccagcacttgtttctattcatttatgctcaggtaagactattttaaaaagtacactattgctgtgtagatcctttaacactaaggatatcaaactatatgtaattttctacttcaagctttttttaaaatcataatatgtcttggagatggttccataataaaacattcagatctacctcactcctttcaatgactgcatgcccatggaatgaatacctcattatttatttagccatcttactttctggtaaatactgatattgtttctgttttgatttttttaaccacagctacgaatgccacctctttgggtatgtgggtacgtgtctacagctgctcattgaggcagatattatctttacagcaaaggagactgaggctcagagaggtgacacaggcagtgaatagcatgtccaggaccagaagccaggtcttttttgttttaaatccaggtttgatggattttcttccctcattccacagctacctcccacccttatctcatactgggacatttgcatttggcaactgatttcctagcagtaacatccctggggtggccctacatgtcgctgctccttttctcactgtagatgatggatcagctgctgtgtgtccctgaaggaaggcagctttcaggaggtggacagctgtgtgtgaataaaacaggggaggaggggatccacacatacctgtcctgacctatttaccgagcgagctgttgagccaaagcagcaccgtgttatctaaccacagctaaaatttgaaaggtccaactgagaaatgtcaggaggaagtaacacttgaattattaaggaagtaggtactaaaggagatggagaagaataacctatgaaaccggcttgttttgagcaggaaaggaggagatggatgttctaagtgaccgccataacttgaaaataaagtggttcctggggcctactaaatgtttaaatttcagagaatccaagcttctttttgatgagccttcttcagtattttacaacggcatatcgaaagggtttcttaattaaaatccccagcacgttggaggggcgggctgattgaggctgcagtgcctgcaggcagggtgcccacctccatcagccacgccagccgaaggggcatcctgcagctcctctgtcagagggattcctgccggagcacctcctggcagagagcatgaggcccggccaattcaatgtggcctcgctgccccagcccagccgggacactccccaggacccaattagcagattggaaatcgcatccaagtatgttacaatcaccaagttaaagaggaataacagacatgaaagaatcaagtgggaaaagaacattttggatcccgaaagagcaggctgcttgtcggagttctaacgaaccgaaacaaaataagtagtagctccttaagcctcttttctaacactgctgggattggttagtgtagagaaaagcattgaaattgcaaaagaaaaaaatgcttattgttcctatgttcaatttgttatttaatataacttgttttttaggaatttaataaaaaaaaagggagggcatcattaattttacattctgcaagaaaatgaaaaatgatctgctgattagtgatgtgcaatttgttccttgaacatctccagtaatgtgtgaatgtcacattacataacacttataatgattaaaccagaagatgaaataagataggatagatcttgtgttctttccttgactggtggacaactcatctcattaatctctctttggcttgcagccttaaattgaataagccgtgttactgggggagatttatggccaaaagacttagcagcctcactgaggaaatcttatagcaccattttgagagctctccaagataattcttgggatttgtattaattgtagcttgtcataaaacattgcccaaaccagaaatgagcaatgaaccttctcaggaacttaatattacagcaacattgaaaatatgcacttcttgatgttccatctcatgagatgttaaaacattctgagtcccaatttaaaattattatattagaaatggtagcttcagtagagtgggaaatgatagcttcagtagagtgggaaatgatacactgatacacctgggcactgaggaatgtttgtagaaaaccagtgggctttcaatatcacaagggcagtccttcgcagagcagtgagcaggatgtccctatgaaatgtttgtagaaagaatgaaccaactggtaaccatgagtcctctttttaaaatataagttctctttgtggttgaatttctgacacttggtgtataagtaccagtaagtaagattggcttacttgttgcaatttttaaaggaagtgccttgccacagccagaaccagtggcctggaactaaagttgaaaagaggttagatttaataagtcatccaatatatacaagatttccctttagcagtcatcagtaagccttgcttgatgacttattccatttggggtgttcacttcctctcaccgtagcatgtttattactggactctgggctccttgaatgcgattctgtgcccttttctgtagccccacatgtcagttatgcacaggacacactaaatgctcaacaaacactttctgatatataaaaccaaaattattgtttatatgaagtcaaaatctacctccttgaacttccatttggtggacctagttctatcttctgcacaaaaataaacatgtcaactccctcttccctgtgagtattttgaggcttaatcactcctcaagtcttctctgtgccagattaatccctagttccctaaattaattattttcttaagctgccatgtcaatcattttgtgcttcctggtcaactaaaacctcaggtttttcttaagtaatataaaggaaacatttcccctcatcttttattggagtcatgttttccttttaatctttttaactgaatcctacttaccattttcaattttaatgatactgcttaaccaatctttctaccttactgagagtttttcaaatgctgattttgccaataatgctgttaccatggtgttgtatcttttgcagatttgatcaacagtactggcatcagaaaaacacagatgctttggtaggtgtcatcagggtcctcatctctccctatgctggcattgatctatcaccttatgtgatctttagccccatacaaattctcatatggcattagaagtaactttagaaaatattaaatccatttgtcctctctattgatactatacatgaggaaactgagtcccaaagagcccatggccacattactggttaatagaaacactcatattagaactaaggtccaagtgacaccaaaggcaggtgtcctttcctgtttatcatagctgccagtctttatattattcacaaggtcaatgcaagaaacatttaaacatctcgttggaatcccaacatattgtgataggtttcctattacgtgagggttatgtaccactgtcaattagaagataaagcaaagtggtggccttttttatctcttattctaagatcttcagtaaaattccttctgtttctaaatataaagctttaaaacaggctatattgatgttgcgaaagaactggtacattataagtagaagtgtgtgtgtatgtgtgtgagggaggggtatacacatatgcacgtgctttatatcataattaaagagtggaagaaacaggattctttactggtcaatgaaaacttttcagaggaaggcaaactggtcatttatacaaaaccgtttgtggagcatgtagacttcctttgcactcactaagaaagcactctttttaacgagggactatacatttgttcaatgaaaagaaaatagctctttgtaccttgctaacggaattgctaactattcttcagataggagtctcattgttcccactattcagtatttaaatacacataatgtcatgtctttactgccattagtcagtattttcaaagagctctttttattaaatttctgaaacccaggaccaaagaacactttctcttaggtatatattatttgttagaatggaaacaatcaatacattttcagagtcaaaaagcactgggaaacagtttcttttttggtctgagcatattttttattaaaaaaaaaacctttgaaatattttgttttatcagaattgtttgtagggaaaatgtaaacctcactattgtttaactgcagtccaaagaggactatcatattgcacttctaatcaaaaaataaattgaacatagtggtaggcttacagaaagagagagaattagatttgattagattagctttaacctgcccggaataaaactgtctgcctttcctgttatttgtcagtgtttatagcgggtttcatctacaatgctttcactattatttctgggcggtaaaaggcagtcaagcagaaaagacactcataaatgtcagaaaagagtaagtttttttttgcatttcaagggctttgaaggtcaagttcaacccacttaacggaagcagagtgatgggtatgtggtagcatgttgttagctgctgcgtttaggcatataatttatgtgaagttaatgcacttgtccatcactctaagaaagcaaaaggtcctgggaagattctatttattttattcattttgttcaacttttagaaggtaaaataattcaaatttccataatttgtgatggaaaagtcacatgtttaacttgttaacagctgagcagggtagagcactgtaatacttccctgactcttcctgttgtaatttgtttcttcttctgagcagctgccccactccatgctgggcaaaggaagagctctgttaagcatttttgcaaaccagtgggcattttttttttcctctggaagcctttattgagatgttttctttttctttttctctatgaggctttattttttcccaccagggagcctgagcaattatagtttaaagctaccgaagataggtatgttctttgatatcaaagagcttcttgaagatttttcaaactaaagagacccaaaggttgtattttaaggtgttactagcatggccctttgtagttgaaaactctcagaatgtctaccaagtgtattatgctttgtttggaaatgttggacctcggtactattgcatttggtaaaaggcagggtgttagaatctgtgtgtatgtgtgttcctactgctgctcagtggagtctctgtagttgcaaattgtttccctagtgatgtaggatgactagagagagaatagggagtaaggaataaaatcgacatttattgagcactcactatgtgctagaggcataatgtatgtaggggatagaaaatcttatctctattcttttggttttgttcccaccttgaattgaattgacatagacagatcaatgggagaaaaatgtatttaatacaaattttaggtggcacaggatccttcatgaggaaatgaagacccaaagacacagttattgttgaagacttacatactgaactggaaaaggaatagtgagctgtgaaaaagaaaataattatgtggagagactagaagataagacttattttaacaaggttagtacagaattttcttagtctcagcttcctgtccgtgatgataagaatgttgctttctttctactatagggagggatctttcacatgaaatccataggggaatttcacctcctgcttttgggaaacagatggagggtcggagtgatcttgcacctcctattttttaagtgcttttagctcaaaataattatgccaaagtagcatatgtgggggtggtgtgttctgaacgtttttatgcatcttatttctttcaatcctcatttactctgagaaatggcaggttactatcctcatgttcctgattagagaatcagaaagggaaagtttacttgcctttgagtcaaaactggtttctttaacatccatggttgcctcactagaatagtctccagaggggaggaagtggaggaaaaagaatgaaaactaggaaagcaaagcaaacttcttgggaagtgtgtgtgtctgtgtgaaaatacatttttgtgcaatgaaatggtttgagtactgtagctctgagttctttcgtagctttgagaacttttaccactaaatggtagaaattcagttgttctcttttctttctaaggaaatgtctttgggtcaccccattgaggtgctaacttgctgcctctttcctggacttcttttctcccatcgacccttctcttcttctattcgtcaattctcaatctgcaaattcctgttgcctttcatatgtagaaaattcaattctctctttgtttttactgtccatttccagaccatgctttatcttagaaaccccaaatgtccatagcagtgttttactaaacgatgaaccatgaatgtgtatttaaccaatgagtgttgagtgccacctgtatatcagatattatactgggatgacatagtggcaaccaaaacagacacagttccagcccttgtagaatttcaactctgatgagaaagaaaggcattgtgttattttataataaatatattctagtttttcccctttatactttctgctgccatcaactttattattttgggagaaaagattaaatttcaaccctatatcttgtatggtgcagttgccccataaatgtgtgttgattggtgaaaaacatcaaatctctttagccctcatattttcttgtcacaaaagtattactaatattttgtattaaatggtcattgaagaaaatcatcatgtgtagttgagcatcagcattggtcagcatctgtatagaacttgaaagcctataaagggaggacttttatggactttatcagaagcaagcttcataaatctgtggagaaggggctcttctctccattttgcagttgagaaatcagtagataggaactaatttgtccaaggtggagatgagaatctcatctctcctgtctctaaatcatcttttcttttgactatattgtctcttgacaataatttaaaagtatctcaatatccacagcaataattattttttgcctgaaaattacaggagcagattatttcattcatttaatgtattgattcaccaacatctcttgcacatctaatatgtgccaaataataagtttccagagccaggggtatgttgtccttttccttaaggcattgtattctaacttattggggtagacagaaatatgactaaataaatacaggatccttatttaggatatagaaggacacatgacataagtatagaataagatatccttgtggtataatggaaagatcattagctttttaggtgcgcctggtttgaatcttgacatcaccagttactagctgttaatttgagcaaatcattcatctttttaatgaacagttgtctcaactatgaagtgggggataaaggtatttacatacattgtagttgtaaagatcagaggtgatatgtgtacgagacctagcatgatttcagaaacatagtagatgctcaattaatggtactgcaattttatcatgtctattatacagatatataatttgtactgtatctgtttgttttttacctacatatctaaattttcttctctatctatctgtctattcctcaagaatcaagagactaacttcccgaagagacagaagaacagctaggagaagtatcagagaagtaaagtttctagggttgtacaaaaacttaagttttgtacagaaaaaaaaactatactaatatatgtggcaattgaaaagtatggaatttatcaagaaccacaaaaagcttaccatggttaaagtatagggtacaagtttgggaggctgagagatgaggctggaggaacagtcagaggtcagattatgaaggggcttttataacatgttaagacacttggactttatcttgccatatagacaactccctctcacctaagtaggaaatgacaagctggcaattaaagtgcttcaaataacgtatcttagtatgtggaatccttaattgtgtagaaagaggagaaaatctatctaaaaacttacccaagaaaccaacacatggtatatactgaacaagaatccttacgattgatgggcaaaggagaggtgagatttctagtgaaatataaaattagaaagtatcataaaccaaatcccagaagcagcatgcagggctgaaatgttataggccaaagcaccctcgggcaaattttgtccattacatggtaagttctaaagcagcagggacaaggctcagagtaactaaacccggatggaacacctgcagtttttccctgaacgtcagcataaatatttgacatgtcttcctttctgtgaaggggccctgtcccagtgggagtggtgtctggtatcccttagcagaagtatttgttttcttaagcttttctttatgtcctagaggtggattctaaaagtccctaacgtattttgattttgaattttcacaaaagtatttttttctttcacagtaattcagtataaaaggcaataaaagtgatgtatccagaaatattcaggacctgctatcagcaccacatgggaataaactatcttgccacttgcacatcccatgggaaaaaagaatcacaatccacatataggaaatattgcatgtgtttgcctccgttttgcttgtattgtctgctctgctgaaaggcagattttttgcagataaaagctgccctgcgttggtgaactgctcacctattttactcaggaagaaaaggctttgtgaaaatcaggagcaaagcctgatttgcagaataccatctaaaaataaaatgcataaaaatgtcaaaatatgctaagaatacagggccaccttcatgctttgaaaaattacctagcaaattcagcaaatgctgtttttaagtgaatgtaaattatgtgttttcgaagtttcatcttgtgaattggtggctaggtgctgaaggagacatgagggtgtggaggcggcctttctcttcttgctgcactagggcaatagatctgtggttaaagcagatgaactgggaagctcttgatcaggcatacgaaatacccagattcttgtatattttctagtttgtgtgcacaaggcttctggcttggctgcttttgccagtggggaagcattagtgaacaaaacagatacagcttccagttttcaagagctcacagtctagcaagtcactgcaactttaaaaaggggatgtacatgtgtggtttaaagtatggtgggtaaagcctttaggggttgtaaaagttcagtcactggggcctaattctgcaaaagagaaattcttcccaaagctgggatacattgagtgtcttgggcaccagagcagaagttttagttaaaatattaagatccagcacaaagttacctcccaccagttgaatctgtttttgaaatttggaaaaatggcctctgtttctccacaactatgtattggtaattcttccctggggactaacttcatatatatattttcacaataatgcatactgaataaatctgaatattttgcttatggaatcaacaaataatctccagagaaagtttcattatgcagtcatatataagatatgaaacagattttttccctttattttaagaaatatgcatagcataaaaattctcaggctctctttgctttatgtagcaccatttctgataagataccaggtttcaacaaactggctcagtggacatttaaaattcccattgtgagtgccagggcttagtggaagatgtttgaccatgtgcgctaacctatcagtgttcatctacatattgggagactgaacctgatctattctgcacaactggacagaaaaatatggaggtgggttctcagccaagggttaaaaaaggaagtaatctcttttgctgtaaactttttctcagcaggtgtaaaatagctgcaatcaggtaggctttggtaagtggcagctgctatctgcccaattgaaagatcagaaattctcaccctatttctgtttcaattatgtagacagtggctccaattttcaagtgtctaaaggcatgcctaactctgtgataagaaatggatgtgggccagagtgggagccatgtgcaaagctgtgctgcaaaccctttttctagtgataccagctctagacaatcaaggtccctcggttatcattatagagtcattaaactcaggagccagcagtgatcactaaaaaatggatgtacagatgaggaaactgaggcctagagaggttaataatctgacttgtggtcagacagcttgtagacttatctagatatagcctctgtccttaagctgctgcctaaggacagctaagtgctaagtttattgctaagtggtaaactgattagtatcacaaccacctgcaacattatgttgagaggattctgaagttgcatcctgattcaggtggaaatagtgctatgattgattagcaatgtctgcctggggagaaggtgggatatggtttgctgtgtatttgctgaatttggttgaatgatgatggctgctttgtaatcacgattgctacaggatgtgaagtgtgcttcagtcagaacaaagcgctctgaatcttcttggaggggcaggacggtttcacagaggagacaacatttgaatttgatcttgaaggacaagtagaagttttcctgagagagaaagaggaaggaaaggaaagaagacattgcatgaggaaagaatagcttatgtaggcaacctgatatgtggataaaaaaaggaaattgatgatcattgattgtctgctatgtaatgggcactaagctaggccttttctgtgttatctaagtatttaattttcataatgaccctttggttttacagatgaggaatcagagaaaaagaaaattaagatgtctgaggtcattcagctattaagtagagctaagattttaattcttggggcttcaaagtaactttagtggcagcaactcagaggaacagtataggtaaggaagagtggatcagagaggcagagatcattagtttggatttggactattgaacttgagttgcttctgggacatccagattgggatggctaatactgttggaaatctggcacagagtgatctggtgatggtttaaaaaaaaaatcaaaggctctttgataacagaccttgtgcattttacatctaggttcctgcctaatagtggagatgtttctgcctttgctattctagcaggggaaactatacgtaataaatgcatatgctttatattgttttagtgattcaaatgactgtcaatgcaatattaaattcagaattgataggaaaactgtcctacttagaaattcaagagttcttggcacaatactatttattatcaccatgagacctgtgctgtagcaaaactctgcttgtgtttcggtgaaagactgtttaacatgcatgtttcactctaccgaggttcaactttgacctataagaggacagtgtatattccttagagagatgctaggaggtaccacaattgatatctatgtatgagaagtgggtgggatatgcctgcatgagcaacataatctaaaccaagttcaaaaaaagaagttttttttttttccacaggtgcaatcttgacaagaagaaaaatctcaaaaaggtattttgcattggtaaattctgatgtcttgggcagctccaggactgtttgtcatgctttccttatggacttctggttatgcctccttaaggatgtgggctgagggataatcatttaaaatagtccaggcaccatttctgattctttgttccctagaatgatgatggtggtggtggtggtgaccacaacggtgacaacaatgataccaccatatttcattgatttttaaaatgtttttccacattttcagctatctaagaatacttatactcagtacttccttgcagtcactgtcagcctgcaacaaagttaaatttgtccacagaggattggcattatttcacatggtcacctggggtcactaccaacctgagaccatttaaagttatttgctgaggtgttttgtttgtttgttttcgcactgtcagtatgaacttgtatcagaaacctgcatgagtatctgcttgtggttcaagttctcagggaagattatttttcctctttctcttcttgctgtgcctttctgaatggaagctttctttctggcatattctagtgctaagggaatagctgtttggtgtttcagctttttgcagaggtctcttattagactcccatcttacttttctttcttattctatttagagtaacagtgtgactaacaatcgatggtctcttatagctgatgaactactgtaacaataaaagctaacatttacttagcactttccttttaccaggcagtgctctaagggctttttatatgcgataactcatttaaaccttcaataattatattagatgggtactcttattttccccaattttaggtaagaaaacgtatgctgtgtgcccagggttgcacatattgactcacttagtgttaccagtggagggtgtccaggttctgggcgttttgaacaaagaattgcacaaaacacacaaacaaagcaaggaaagaatgaagcaacaaaagcagagacttattgaaaacgaaagtacactccacagggtgggagtggccagagcataaggggctcaagggcctggatgcagaatcttctcaggtccaaataccccctagaggtttcccattagcctgatgtaaatgaagtggtgttcacctcatgtaaatgaagtggtggtctgcaaccagtccgattggttgcagaaagcaaccaatcagaggctgagttacaaaggtcacagtcctatgcaagttttctgcaaccaatcagaggctaaagtgatgttacaaagttacatttctatgcaaacgaagacttggcccacaatcagtctgattggttgcagacagcagttaatcagaggctgaagtgaagtttcataggtcacactcccatgcaagcatctgattggttgcaaaaagcaaccaatcagagatactttccattttcaatctgccacctagaaaaagtggggttttgcaaagggagtggtctctggtccttttgttacctagccagtggaaagttagggtttttctttcaatttagtcctaggaagtcagcgtgaaacggccttaggttccctgcctccagaccctattctcttgcctcattagtgtaacttgaccacctgagtctaccggtacacccctggtgagaatccacttttagctttgtaaagtacttggcataatgcctgatacttgctgagtacatagtgagctgttgcaagtcccttccactaaaaaataagctattgtccttatcagaagaataggatactcttttgttatctatttctcattccatgatataggattctagctttaagtgttgtcaatctcagacaagagttgattatctaaaaaatatggattcttgtaagccttttcattatgtgccatataaaaaatgttgctccaagcaggtttactagtttatcaccattcagatttacaagttctatcaggaacttcaaagcaatttcctagtaaatttcctagtaaaaagtccagtttaacaaatgtttaaatttttctcacttctctttatattttaaatttttctcacttctctttatatttcacaccctaaccctctccctcactttcccattccccaccacattcacctcaaatctacacagaaatcttaaagtgagatgaattaagaaaaaaaaagaaaattgccttttttcttttatgaaaaaacatatttttataataatctgaatctgaaatttttgaaataatttaggacttatatttagaaaaaatcatttaatccctctgtccttccttctttctctccttcattctttcatttcttccacaaatatttactgaatattttctgttaaagacattgtgcttgatactgccttatgagatatatttctcagattttgttcatgtcctgaagaaattttcaaagacaaaattaagggggaatctttctctccttccctcccttcctttctccctccactctccctcttccctctttcctccatcttctttctccatccaccccatcccaccccacccttatccatgaactagaagccaaggaggaacaaatgctttatgggggaaacactctgagcaagttatattggaacttgcagagatgaggatggtagaatacagcaagggggccaggaggagcagcatgaacaaggtcacagtaactggatagcaaaggggctttagagaaggctgagaagtccagcttgaaacatggaggacaggaaagggagagatgggagaggagacttcccttctcacttcacttgttacagagagatgcatgtgaggtgtgaggataaatgccatttaatgtaaggtcatgtagattcacagaaaaataagagattccagctgatgtcattatcatcgtagtcattttcatcattgtcgggatgcctctggcaggacttcctccctaatgacaccaggaccaccagaatttacacttatgctctgcttctgtgtcctgaacaccttggaggtacgaatggattctaagagacaaactcatctcgtttagagtgaaaagatgacaagcagaggttcgcagaagccacatacaaccaatgaagcctataaggtagctgagaattaaacaaaagcacctgttccgattaccttcattgttcctggttagttagcacctccctttcctcaacagaatgcccggcgcacaggggtgggatctgagtgagggcaacaggtggattggagaacatttcttcccataagtagtaggatttgatggaaaaacaagtaacttcagggtaataaaatgatggaaagtcctgatgggtcaggtccatatctaatcttaagaagggcagccttaggcagcatagtgggtgctagaatcattggtaccatcaagaaaagagtagtaatgtgaatttcaaagaagatcactttgggataatgaacagcatgacagaatccgggagcctaatgaagaagatgtgatatagtaaaagaaatatattgagtgtaggctttgaatagggcagaaggagtggaactagagaggcaagaggagatgtgattatggaaggtcttgtatatcataccaagggtctgcacttacactgtagagtccagagggatctaaatgtaggatagacaggatcaggtttgattttggaaagctcagtctggaggtggtgtggccaatgtttgggaagtggtaaagactctttcgggaaagacaatatcaagagcaaacatggactacttcatcaggtatcaccagcagatattaaattatcagtacaaaacccagcaattattactttcagatcggccttttttctcttactaggagaatatagtccagatagagtgtacgtgcatgaataatcatcatagtcttaacagaggatgaagtttaatgagtgttatcagttagagaattatttatataatctcagttttccagacaaagaaatagaggcatagtgagatgaagtgactgcccaaagtcatagatggagaaaatggtaaagatgacttgaactctgatattctgcctctagagcctgtgttctagtgtgtgaattaactaagttgttaattgttattcatactaatgggaacattctcatataactggttcagaaattttaaaaactggtaccagccttaggtagattttgtaatgcagtttgtcagtaaccaaaatacctaattcatatggaaaattaagaggctggtgtgaagcatgataattacatttactttgaaatcagcaatttgtggataaatttaattcattttgcccaactctggctttattcccggtattaaaaagacaactacagggtgcacttggttagcactcagggaaaataaagcaattattcttccacttctgctagagaacactaggtaccctttgacagtcaattgtatagactcttattgtaggcagtttgtaggaaccaacctgatggaatgggtatgtcttcctctttcagctccacaatccaatgacccttttgttcaacaaaaacacaactaaacaacaaaatgttggtagttaaaaaaaagtttaaaagtaataggacgccttcaacatggtaatctactttaagaatttagagcacatgtcagtatgtcaccttcagacatggttatagtccagtaagaattacaaatccaacaaacaaaaatcaaggcaatagagttttcatgggtaccactgtaataaattcttctgtgcaaaaagccagtcctagagaaaaattataggtagcaacattttctgaggaacttttttcccaaaggagtttttttttttggggggcggggggtgcagacattattgagaagttcaagttaacatgagcattatgactgtatcagatgacatgataagaggttacattgaactttctaacacctattcttaaattataataaaaaaactcattgagtttttaacatgcctgtacattttctcattttattcagggagtagatttaggtttttctggcctgactggatttttaaactgctacaagataacataaaaataatcatggctatattcactgagtttgtttcattttgtaaaattatgaaaaacaagtttatctcattcagtctctttagcatattgattcagtatatctccctttatagaaaagaaagaaagcaaggattttcacaagatagagctgaagactgatattgagtacatagaatgaagagcccagaaagcaacgtctctcagtgtggctggacagatagacacaaataaatttcatccaaagggttagttctgattatgagaacatgggagccttgggccttctttacttacccatacccctaacaaattagtggggtttttcctagagttcactatagtttaataagcgggatacacccagatttttgattcaacgatgaaataaaatgaatgaaggttttatttatatactctgtgctttgctacttcaactttgtgcaaatggaaagaagctttattgcattcagagagaattagatttggaacttggtcagtggcacaagatagaactataacatattgatgagacaactttttatgtgggaaaataattagcgtttgataaaatcacaaagaagcaatgggtagggactcatcaatgtgtgaagtgactgagcactgatacacataacacagttgacattgtctttaatatttattattgaataaatgacagcatgtgaacaaaagtgtatgcttttcacactagtgaatacttggtcattaaacaatagttaaataaaaaacacaactttataccattggttataatttaggaaaaagaaaacaaaaacatctgacaatagactggattaaaagttaaagattttattttgtggttaaagactacttctacagtagaaagaataaaaacatatacatattaatatagattgcaaatttgctaggtccggatctttgcacttgtgttctctcccaaaataatggattttctgtggattttattttggaataggtatttctcctatgaagtctgataaatgatattcccactctaaagagcaagcagctagaatgccatgtttttgatgcatatttttgcagcacagaggggattaaattctaaatgtctcagctgttaaaggccccttcagacttgcccaaaatgaagaacaaagaaggagaaagctttccctaaagcaattcatcagatctatttgggcacagtgacattttctcagaacttatatggataagttacactgaacagttcaagggtttgcagctgcttggaatatttaagaaaaaaatatctctagttcttatgcatttcatatggtctgaccagtgctcaacactagctaatgttcactgaggctgtaaccatcagtagttatgtcgtaatagcttttgtttctcgagagctcattatgtgcctggtactgtgttctgcattttccactcattgtatcacttaatatttatgcttctgatcttaggggaatgactgtttatattgcatatatgccatttttttgcagtatgaaaaatttgttgagccgagtgtcatacattataaactgacatgtacttactgttgtttaatctaattggtggttgttaaatctaaaggatgttctgactacttcaataaaggcagcagcaatcacttccataaataaatcattagacgtagaacacatgtgtaaacaggtagagtcttctaatttgctaagtgttgatggactcaaaacagttactagaacaagccatagatggaatacatttattgatggaataagtcaaacaacttgaaacacggcattgtggtgtcttaaatggtaattcaaataaaatgaagtgattgatacatttttacttgtttggaaagtggagaatattttagaattgcaaaacattgcacttttatatacatttatcctttcattatcctaatgtagggtagataggacagttgattgcatccaacttcatttatttggcttattatcttttgttttatgattttaactctgtctagaatcatctcctaccacttagagtctatgtattcttctgaccaaatgacttcaagttttctgaccaaattaatggcctttcaaactgttaagccctctgcctggaatgcccttcacatcttctcttggcgaggccgccgcggtcctcaggactctgttggaatatcaccaccccagacaaacattccctgaactgttcctcctatacttacccttcctctggcctcccacagcaccctgtgtatacccacattagcatcatttgacacctggtattatagtgttctatttactggccagctgcaccaagttgtgactctttggaagcatggtgtgtcttttatggttttatttcggttttttcagcacctagccaagtctacacagagtatggactcaatgagcgattgtggcttgaagatgtaaattctttagtatgtattgcatgatatacatgtgagacatgcatgtatatcatgcatattagtactttgttcacttccccacctcccacatccctatgacacacacacattctcattgcattcagcgatgtgtagccttctgtctcatccatggttttcattgtagttgctgaagcttgaggtcacgatctggtggaagtgactactagaagaaggcacatgtgcattgtattctgttgtacttgtcatctggagcacacagtgtacttgaaggtatgccttttctagtggaatttcagagtggtttcatactagcagtatgagaacactttcatgctaaacaagaagggcaaagaatcaaacccgggcaatgtaacagaaactgagctgggggcctgagctgcagaaggaacctctgtccactgcagaataccactcccagtggcacacagaggagagggtgtctggcttctgctctctggttgctcccttcaccctctctgtgctcattacttggttccctttgatagaacatgagaggcagacatgggttgccagggagcaggcttttacaactgctatttcatcctgttttgaaatttctctcaaaatggttgacttatttttctctcacgtatgcatacgtatgtgttgctgcacacaacagtggattcagaaaggctatccacatctttgtccccaaacccccagccatgcaatgcaatatagcaaccaagagaaccagagagccgtgctgagctctgaataaacaaaagcacaaatcccatctgggtctccttcaaagcaagctgctattttgcaacaagctaccaaatgacgattaagaaaaaggttcttacctgtttacttaatgggtgactggcctctttgcttttatttagccatctgttctggtctatgtccctttaaacttgtaagatccatcacttcattaaactgttaccttgacacattgcaatgttgtggacataatgattccacagaggagcaaattaaaacagtttttcatgattagaagcttaaatgaggtaaggctgtggtagttagtggtgagataaggggtgttgaggaggcagagctcaaggggctttcaggcgattggaagattaggctggcgagatggagggctggggcttttccaaattatgggaggtgagcaagaagcaagactgcctttgggtatcgctgactcctgggggctggttccattgcccatacagaggctgtgaccctggccctgggaggatacaggaactgccttcaggtttcttgacttccctaggagagtctgcgaagagcaaaaagaactaattccaccgggtagtggtaagctgaaaatgcaacaacaataaacattttggtctttcacagaaagttatgtggctttccttaagttcgaagaagaatcagggggcccagcccaactatatgaaagaatattttattgtgtctttaccctgcacttcatggcttcagcagtcctccttcttgctctagacttaccttccacctgactccttgacagttgctgaaaactagaaagtcaagggctttatctttttactatcttatgtcagttcctgctctgacaactctggtttcttctgatatgacccataatattgccgtcacatggaccccaaatctgaggaatctctgaattttccgtcagccgcttctgtcctgtcagtagcccaagttctatttctcccacctaaatcaagtttctcacatctttttccaccttgttatttcttcttcttctgccctagttttcatccctcattacctctgtcctaggcaattgggatagcctcctaactagtcactgcctacctatactctctccctgctccaaagcatcttaaacactgatgtttgattataactcataacttccccccaccccgccttttttttcttttttaaaaaaattatactttaagttctgggatacatgtgtagaatgtacaggtttgttacataggtatacatgtgccatggtggtttgctacacccgtcaactagtcacctacataaggtatttgtcctaatgctctccctctcctagccccccattccctgacaggacccggtgtgtgatgttcccctccctgtgtccatgtgttctcattgttcaactcccacttatgagtgagaacatgtggggtttggttttccgttcccatgttagtttgctgagagtgatggtttccagcttcatccatgtccctgcaaaggacatgaactcatccttttttatggctgtgtagtattccataatgtgtatgtgccacattttctttatccagtctgtcattgatgggcatttgggttggttccaagtctttgctattgtgaatggtgctgcaataaacatatgtgtgcatgtgtgtttatggcagaatgatttataatcctttggttatatacccagtaacgggattgctaggtcaaatggtatttctggttctagattcctgaggaatcaccacactgtcttccacaatggttgaactaatttacactcccaccaacagtgtaaaagcgttcctatttctgcatgtcctctccagcatctgttgtttcctgactttttaatgattaccattctaactggtgtgagatggtatctcactgtggttttgatttgcacttctctaatgaatagtgatgatgacctttttttcatatgtttgttggcttcagccaaaacagataaatagacaaatggaacagaacagaggcctcagaaataatgccacacatctacaaccatctgacctttgacaaacctgacaaaaacaaacaatggggaaaggattccctaattaacaaatggtgttgggaaaattggctacccatatgcagaaaactgaaactggaccccttccttataccttatacaaaaattaagatggattaaagacttaaacataagacctaaaaccataaaaaccctagaagaaaacctaggcagtatcattcaggacataggcatgggcaaagacttaatgactaaaacaccaaaagcaatggcaacaaaagccaaaatagacaaatgggatataattaaactaaagagcttctgcacagcaaaagaaactaccatcagagtgaataggcaacctacagaatggtagaaaatttttgcaatctatccgtttgacaaagggctaatatccagaatctatgaagaacttaaacaaatttacaaaaaaaaaataaaaataaaaaaataaacagccccatcaaaaagtaggcaaaggatatgaacagacatttctcagaagaagacatttatgtggccaactgtcccctttaacaaaacaaaatttcttttggctttccatcacctagcaaacttagtatagatgtattagcttgatatctgaggcaattcagaataaagttatcatttgtgtttctagctttttctccttcttcgtgctccagtaagacaaactactgtacgcctatgagtaactgtatgtattcttgtctgcgtgctgtttcctctctctggaaagctctgttcacacatatctgtcaattaaaacacatgcattttatcaagctcaatttcaaagacatctttgctttctctcttctcaatcggatgcagttgttcctgtttttcttccatggcagtatgtttagaggaatgttctgctgcttggcataatttttttttcctcttgttacttttttgaatcttacttttgcaaatcctatagcacaggcagagtttcctactcatacagggtgctagatacagaaacagaagaatgagtgataatgatactgtgtctacaagaatgtgaacatccattcattcatttatttattcattcatttgtttcactcaaatgttctttgaatgcctgtagtatgtaaggtaccatgttaagagcctgggatacagagatcaagatgacacagtacattccagttctctaagaactcacaaatccatgtaggaaaatcacataaataattacacagtgaaaaagtacaacaatagaagtgtctttaaattatgggaatgatgggactttacctctgttagagtggataggttgggggtcaaagcatggtggtgaggaggggattgagcaattagaaaaggtttcctgtcattggaaatgtctgattggggttttgcaaactgaataggagtgtacaaggaatatagtgagataaggaagggtggagatgcaatggaagagttcaagaaagcagctctgcttgctctcagcagcccagcacactaggacaatttggtcaccaaataattattttccatttccaggtaaaatatgctgaatgacagaatccttcgacccctatgaaagaaaaagagaagaataaaggaacctccttctgtgactgcctttggttgaaagtcattcgttcttctttttgtttttttaatgttttgtagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagaggtaagatcccagagggttacctagcagttggagagtatccatggtaacagcttttctttaggagccagagggcttccaactcactgaacttactctgtctgccccggagagcttgcttgggtccctgacaacatcttctgtcttattattcttagacatttactgacaaatgtctaaatctgccacccctcctacattaaatcttctgattcactggcttcatatggagtcaaggaagcaattacttgttttcctggtggtttgtggcacaacgtacatatctctccatttagaagctctgattagcagttaccagctggagaactagctggcttgatttcctgtaggtcaactggttggggagagctctttatagaacttcaaaaatgcatttatactccttaaaactctgtaatccttagacctggagctagaaaaggccaagctgattttaaaatttgcagtggctgcagagataatgggatttaaagagttttcaaatttaaaggggttaaaatcgtgtaaatcctataatcacagaagctttaaatctttgtagccaattggtagtacaggagaggatggaggtatattgacaactagaaagtgcacactatgctagcgcttttgcaagcaagcatttgtctcataaagtaaaataaaaataatgaacctcacaaaatatgtgatgtatatagaagtgcttaataaaattgttttcactattcatttctatggagttggatgaatgtgagtttaatattcagagacacaaagtccaagcctgtttgaaattgttggtaacaaaggtacaagctaccagtgtgtctacattactagggagagtcttggatcagctcccatcgaaaggtcattttgtaaagatactagagggtagagtcatgcatggaatgctactcctgtcctgagagttattcttagcattctgggaggatgctaagcttggtctacccccttttgtagtcaatctcatatctgagtcattgcttctggttaatttgattcttcgaaaattgtttctgtatctgcaggatttacaggcctttattagaattttatagttgaaaaaaagcaccattaataacacataaattcttagaatctttgatgtttatcctctaattggttttaaattaatttttttacagtgtctattgcttgaatttgttgagtgtcctaataaattgattacctatataaaaatgtatctctttgaggagagtttgtctcaccctcatcttttgttacttttatttctggctatcatttaatattctataactctactgtatggtgttaatcaattcacaagtgcctgtcacaggctgaaaatgaaacatgtgactaaaatgtctcacgaagtattctcatatgggaaatcccgtcaaatatcaaagaccctttcatttctttaaatattaatgaatttgatttcggagtgtgaaaggaaaaactgacctatggatgcagttatttaattagttctattaactgggctatctttgaaattattttgatgtagtttttaatacaatgattttacaaaagaatattgaatattattttgctcctgcaaaggttatttcttaggagaaaacatagttactggaaagaatctgggctttggaagcacacaggcatggtttgagagtcagttctaacatttaatgaacttaagcagtatatttgcttttgggtaacttccttaacctcagagccccaatttccttatttgcaaaataaggataacaacatcagcctagcaaaattattttgaggataaaataagtcgaagtatatgaggttcccagctccaaattgctattcaatgaatgaattgcttttgctttctctgtactttccagtatggcataaagtgttcagtatgaataacatcaaattatcacagtccagagtaccagaatttatatgtacattttaaagatcctggacttgggggaataaacacatgtaggggttctcaatctcattagtaatcatggttttacaaattaaaaccacaatgagaaaaatatttaaaaatcacaaagagatactaatatacatgaaacgccagattggcaaaaaattaagaagtctgacaataccaagtgttgacgaggatgtggaacaacagatactattgtatacttgtagtgggagtaaaaattgtaatacccactttggaaaaaacagctccactgttgtattgagcaaagttgaagatttacatgctgtatgcccaaccatttctagtcatggatatctacactagaggtgctcatgaacccgtgcactggaaggcatggacagaacatgtagcagcatttttcctagtagccggaacctagaatatacctaaatattgatgagtaggagaatgaattagagtcgtgccacatacatttggaataccatacagcaatggcgatgaagaaactgcaagtatatgtgaccacatggaagataaagcaaagtacacaatgtgattccgtttatgggtcacaagaagagactaaactaaataatgttgcttagggacatatacaacggtaaactaaaaaaggaaaaaaaaagcaaggaaattattattatgaaagggggtctagcggttacctctgagaggagtgggcagcttgtgatcagaatgggtttctggggatttagcaatatactatctgttgatcctgttggaggttacacagatgttcacagtccatttattaagtataaatttatggtttttggacttgtatgtctattttattaaaaaattcaaaatatattctgatcccaggaaggatgtttatttaccatttaccatggggaaggaatcatacaaaacaattcacctaattcagcagcaggaaataactaaaaagaagcaatgggatattaagctatctaaagcaaactaggaatatttgaaataggcaatttgattttctataaagactaacagacacataagcaacttatttctctagttctggtctatgcatgatagaccccatattgcatcatgaatgcaggtgatagagcagaaaattttgcatgaaagttgaaaacattagaacactcaaagggaatgacagattttctcctaaattcaagtagttctaggctaactcgggagaaaataaaaactttgtgactttttaccacccttctcaatgatttcatcctttgttctgacagtcccacccctaccaccatgtctgtgccatgctcttactcccaaatgattgtgcatttgttctcactgtaatgtcctcaggcgcaatccgttgcagaaatggttacattaaataagagacacagtatgataaagctttcaagagccaaagtaatatagctgaaatgataggtggtgagttcagtgttctaggacaaatagcttaaatagtgaccacaaaaccatgcttcagagattatcacacactaagtccctattcattctattctaattctgagaaggtcaataggcttagctgaactgagtcaggtgatcaccaagctgatctacttatttcaagatcttggcccttaaagttttctcagaagactttccccttaaatgcatatggtttctggaaattactaaacttcttagtatttttttaaatatgcaggcatgccagcagtgatttccagacctagagcatctgcaaacaccatggctgttaatgatgggtttactgcctgatgcttcagcttggccagaagttgctgtaactagtcatagattttatgagctgaaatgattacaagaaagaatgtctctttactactgtctaaagaaaagtggaatgggaggcagcagaattaggtcaaacatctagtggacactgtggagtgtagggttgcttaggagcaaaatctgattctttagttatcttttaaaaatagatgactctggtccctttggattggcacaagtgaaaatatagctggtttgtgaatctatgacagcctgccctgaaggccccacatatagtaaattatacccagtttaagctctgcttcattttatcaattaatctgttttttttaaaaaaaataatctgttcccaggggaaatacaaaaattaaaataaaaggaacacaggagagatgtggttttgcttatatttcaagctgtttatttttttccctgatgtagatccataaaaaagagcatgtgaaaactgtgatgactattataaaggggttaaatagaaagatcaaaatattcctcccactgtaataatgatgatctaaatataacagagttggtgattggctttaactctttacctttacccagtctccccttcactttctcaatgagtgtaagctaaggttcttttctatgggggaggggaagtcttgagaagcagggaagaaaaatgagtgccaactaactgggtgagtgctgaaattctgaaagtcttcgctggccacggagccccaaatttctcatcaacacgtgtttaagctgatagcaaccatgatttcaaaccaaagcttggatcaggagtgatttagattttgcaacagaccctgccctcgcctccctgctgtgtcattaccgtgtctataatgcaatcccccattttaaaaatgacaatgtggagattccacctatagcattatggcagaattactgtattatcaactggctttggatatggtaaaaagtatatgtcacccatgtatttttccagaaaaaaattaaaaacagaaacgtgcttcacaatatcctaaaaccctattttccccttgaaacaaatgctatttattttaaattattaattatagcagacagaggaggtataaaggactaaggtagtccagggcttggttcaaggtaatcttgctttctcctgttgagatcatggcagatttttgggaaaaaggagaaaacgaacttcaagctaggttctatttgtagttgcctatgagggactcagtcattgtgttgtcttttttgttgtgtgacctggtgtgaagacattgctcagagcaagcagcctgcagtttatttgcatttactgctagatgaaaggatccagcttgggtgatcaataggatgccaaggccagatcttattggtaatcagtgagggtgacagatgtcttccttagacctgataggatcttccccttaagatgctggggctacagaggatttctggtatttggggaagagtgccctttccctgggtgcctgaaatgtgccaagtggagaggtgcaagattgccagaacacaggaagcaagtgcagggctgcatactgacttactcgacaatttaatgaggctgaagtatgcctctttaaaaaatgagaacgttttaaaacctcaagtagactaaataggaatatttaggatcagttgctgtgacagacaggccacactagcctaattaaagatgtgcataacatattgatgttgcaatagaatttcccaaattatggttatagtaacaattaaggaagagagctgactttcttggtgataaaagcacacactccacacatttaaataaatgtacacatgtaactaaagctgacatgaataggttttctatatttggtaatagaggctttgggttttacgtaagtatattgagagcaattatgtgcaaatgtatgtcccaaaagtttaaaactgatccatttaattgttaattaaaatccgaacattcccatttatgtaatcataaagcaaaatgaaatttgagtattaaatgttatagaaaaggaaacagctaaattaacatataataaatcaaaactttgtgactttttaccaccctcctcattgatttcatcctttgttctgacagccccacccctaccagcatgtctgtaccatgctcttactcccaaatgaatttgacatgtgtgtattggatttgtcattttaaggataatttatcatttttctcaagtatgaaaggatatattttttgagtggagaagagatgactatgtttctcagtctggttgtgaaatagcaactttcaatcaatgaccatatctccagacaatctatgagtgccagatgagaaggacagatgccactgtgggttagaatatttccaggaagcttttgtgggagaggtgagacatgtgctttggagaaagatttggatgggacagaggaagaagacaaagcagagttgggtaaaaaagcaaaggttcagaatatgtattgtgcattttccttcagcccctatgactcccagtaggccaaggacactatatggaaagctacagtaaagccctaatgtctatgctggtaatcgtcattgcctcacacttggtggatccatttcatacctttctctggattcaatacctttagtcctaatcgtgtggctcttctttttgtttggctggttatctagtcttgtagtgctcttaccttggccctactgccctgcatactatgtagggggtcacttctaataatgcttctctctgtgtacccctgacatggacacaactccccatttccaaggggcccctgaagtactgcccaggcctctgcaatcctctgacttccagagaaggaagtcaggcacatgtacaggtaatacataggtcaacctggctggaacttactctggaatatagaagaagatagaaaatgcattcattgggtaattatgatctgggaatgtgagtgggattatggaaagaccacactcctatttagacataggagtaatacatacatgtaatatatatatacattcatagttatgaatcagtatatacaagtatatggaaaatacatacatgtatgcatgcatgcagcatatacatgcatacatgttcacagatcaagttctagccacttaaatacaaacatacatagaatatatacaacatactatgttatacattaaaatggtatgtaaaatggtgtgtaaatggtgtaaaatggtatatatatacacacacacacacacacacattatatatatatatatatagtcaggtaggtgtatagtgtgccttttgcggttgtctactctccaccttccctttattagagaaggtggcccttccttttgaccacaagggtgagcagaaaagtcaggctagtgattggtcaatcaagtgattggttgaggggtgggctcatggcccaagatgagccattctgaagccttctcaaattttattatgtttttctgggacacactggcaggaaaggcccccttttctctggtggtaaagctgttgggatgtgattctctggatgtcagtagctgtgttcccaagacagaatgagacaaagacactgagagaagcagaaacaagttgcaaggctaatgtgaagacccagacaacacttcaggtcctgagctcaattcttgaaggcagcctcccctcccatcccccatggtttgggtgtataagccaatatatttgtcttctttttacttttgctggtttgaactgtttttgtcccttgcaaccaaaaaagtcctagctgatatattgtagttattttacagccaccaccaccaaatgttcagtaactcatctttaaacaaggtgccatctgaaggaggagaggagtagtctttccaaatctgcactctcaaacctgctggggggccaaacacaagtcacatccatcagtcagtgcaggtgtctgcaaggggtgaacgctgtctatctttctgcttaggtgcatattgcttagtaaactagcttatccttttgtggtagaaaaatgaaggtcaatttcccaaggttataatgccagaaaatggctggacaagactgactactacctgaattgctagtcgtactcaactgataaatcatatagtttcattataattgttagatgaaaatttctctattgctgtgaggcatcagcagtcaaactagattgattttcactttacaaatcacattttttattgatgaaaaatccattattatcataggttttaatgtagtgatcggttcctcaggaagatataccgcagttttatttattacagagccttaggtagaaaagtccccatttgccaactatcttgttaacgcacttgaaaggggcctattagaaattcaactatcaaattacctcatttgtgacaagcaaaggaaaacaaaacagtgtatctatcacaaataccttgatttgagggttgaaaaagatgatagaactcatgtcctgatgtagagagtttttctatagctcttctcaagctgatggcctggcagagtgactagtgcgaaaagctttcatcaaatggcaattggtattaaccaaataccaaatattttgaaaagtgcttattctgttccagacattgtgctaaggatcagcaatgaactgtaatttaaagaagtgttaaaattggggttcaccaaagaagagaacaacatggacccaagttaggagtatcctggaacaataccacctagaaggtgtttgcattgcagcctgtaatgatgatggctgagtaaccatcttacacaagaaattcatttcactgttcttaagaatagtgaacattcaagtaatttcaattaaacacttatatttaatgtctaaaaggtaatttgtcactaagtagatggcatcaaattgtgagttcttatttttcagagtagccttacaaagccttattcacaaaagaaagatagccattacagaatatttcatttcaaaaataactatatgcttttatatcaaatgttatccaccactgccccccacccccccacaagtttgggaaatagtatgtctggttaaccgagtcatctgactaataggcatttgccaagtatttaataaatggattctttatttattcatttattgacatggagtctcgctctgtcacttaggctggagttcagtggcacgatctcggctcactgcaacctccacctcctcggctcaagcgattctcctgcctcagcctcccgagtagctgggattacaggcacctgccaccatgcccaaaaattttgtattttgtaaaaatacaaaaattacctctagaaataccctgctgtggtgtttcataatatgtgtatttgagtatttgctctgttgtcttcttcaaatatgaacatttatgaatcccaaagtatacctggttcaaatgattttagataagggattgcaggcctgtgtcaaacacagactataaaaatgattaagaatgaataaaatacatgggaagcaaagttctagcaaaaataaaatatctctgaaaaataattgaatataatgactagaaataaataaataaaattgtaatacctcagtggttaggttaaatgacagtcactgtgttaagtattttatgtgccattttcttttagctcttacagagtacatactattttactgatttaactaatttttcaaggcccccaaagtattgattctatgctagtgtctttcattgtcctgtgtggcaaaacaagaacctaagactatcctagtcaacaaattcctttaaatggtttcacagagtgtctgccaattcatgaagtcagtaagttcatggaatcccatttgttgaatttactacatgcaacgcactgtgctaggctctgaaattgtaaaaaagaaaacactttttgcctagggataaataaaattttttcataatgttaaaggctaataaagaaggtagaataacatgtgaaagattattttaactctttaaatgtagtcatagaaagaaagtttggagataatacttcaaaatattaactgtgatggtctatatctgggttgtaaattttagaatttttttaaaaaacatgttttccaaattttctacaatgagcacatattgtatttattactagaattttttttttttgagatggagtctcattctatagcccaagctggagtgcagtggtgtgaccttggctgactacgacctctacctcccaggctcaagtgattctcgtgcctcagcctcccaagtagttgggacaacaggtgtgcaccaccatgcccggcttaatttttgtgttttagtaaagacatggtttcaccatgttgcccaaggtggtctcgaactcctgagcctgatccgcccgccttggcctcccagagtgctgggattacaggtgtgagccaccatgcccggttgaagaagtattttttaagcaatgtatatctgtgaaacactctagaactttcactatcatttaaagaataggatttaaaatgtctagataaatatattgtttggaatactttaaaaagtgaatattctcccattccttaaatgtgggtttctcctagtgactcccttaataggactacaatatggaaaggagaataaatagtaactgtggtggaaaggctgacaaacactatctcagctaagtgatcaaggttaacatcaatagtgacaaatggtgttggtagtatatacccttggtatgatgtgatgaaaccgacactttaccactgaggccatcttccccaaatcccataagcctgtttaatcatgagataaatatcagacaaataaatattgggggccgttctacagaacacgtgatgacaactcctctaaactgttcaggttatcaaaaacgaggaaagtctgagaaacccccacagccaagagtgtcctaaggaaacatgacaactaaatgcaatgtggtatcctggatgggctcctgaacagaaaaaaagacattagatcaaaactaagtatgagtaaagtatggacttgagttaataataattaattgtaacaaatgtattatactatacgagatgttgataatggagaaactgagtgtgggctatatggtaactatcttctcaatttttaaataaatctgaaactattccaaaatataaggtttgctttttttattaattattgcactttcatttttttaatttttcacatatatatatttttattatactttaagttctagggtacatgtgcacaacgtgcaggtttgttacatatgtatacatgtgccaaacactgcatgtactcactcataggtgggaattgaacaatgagaacacttggatacaggaaggtttgcttttaaaaaaggtatttaggtttttgacctgtgcatctggaaggttggaattgtcattgactgagatggagaagaccataggagaaggtgaattgaaaaaatttgaaatatactagtctagccccatagggcagggatgtataagatacatgcattgtgaatacatcactgttttaatattctgtatttaatacaataaatattttggcagagaaatagtgagtattctagaaataattcctgtcctctttaagaagtacaagttcttcaaagattccccaggaacagctgtgcaagtcagtgtggctttctaatctctttcatctatacttacacactataacagttttttctattgcaatgcagcccaagttttttgcaaggtaaattatttgtgatattcttaggaagaaaaggtagaaagtaaataactttttggtggcttggtatggtgttgtattttgccaataactatttatttccaatagtgtttaatgatatttattggattgaagaaagttagctatctttcaggtatctttcccagagctcacaggacaatatttccagcatgcccccggaatggtagacatgctgaaaatattgtcctgtgagctctgacaatctagtacttgtcacaaataattatttttacaattattattactattattattatattattgctaccattggtatacatacacacaaatatatatatatatatttggtctttttgtgctctttattttgtttcattgatcaacatttttttggtaaatgctatttttatataattgttgcttgtagtattagacctacttctttttgctcatcttttttcagaaatctttaataaattcacctctgtatgaatttcagcatcattttattaagtagatgggaaatcttgggtgtgtcagaaaactatttgcataataatgctgtgtaagaaatcacccaaactcagtggcttaaacaattgtttattcttgctcatgtttttgtggaccagttgccatccaggctgagatcggctgtgcttagttccaaagctgcaagttgggtcctggtctgtttcatgtgtctctcttcaccaatgaccattgagccacctggggcatattcttctcatggtggaaaaagcacaaaagactaagttcaatcttgaaagcacattgcaagcttctggtggcctcacatctgttaacatcccattgatcaaagggaggcccaaaatgaaggggggagtaaagtgcacttcacccaccatgaggtcaagtcaagttacatgggcaagtccaacatcaatggagtgggaagtatactcctcctatgaaggtgagagtagagagagtgactatttgccaaaaataatttcattcaccattctggtggaatatttatgggaattgcattaaatgttaacttgaaaacagacactattagaacaattgccttttctactaatatcttatctacacaagtaattgttaagtaatttgctaaaaaagactatgaatgtacatttcaagtagacttcctgtggtatctagtaggagcttaaaaaatgtttgctaaactgttattcatggatattttgtatttttcttatcttgagtgccagctcttaaaatgatatgtgtaactattttagcatgcaaaaatactattaattttatatatgttttcctgcatttggttgctatactgaactcttctaattaagttctggaagttttgggtttttttttttttttttgcattgtttaggtatgcaatctcaatgtttttaaataatctttttctcatttcttttcaatattgattgcattgactagagcttatcaaacaatagtaaacaatactgtaagatttttaaagacagtacttctaatgtttactcacttagtgtaaagctgacctgacctagttttctttaccatattaaggaagaattcaaatgtttttaaaattatttttctaaaataatgcctatgtgtgttgagtttttatcagatgacttcctggcatctattgaaatgactggatgatttttctcttggaacttctcaaggttgtattttcttattttgaaccaccactgccaattaatttcttttttttcatagtgtgtatattagtcattgttctctagagaaaaaggaccaacaggatgtgtatgtatatatgcgtgtgtgtgtgtgtgtgtgtgtgtgtgtgtgtgtgtgtgtatgtgtgtatagagagagatattgagaaggagatattttaaagaattgcctcatgagattgtgggagtaagccagtaggctggagactcagaaagatttgcagtttgactccaaaggcgatctgctggcagaattcctctttgctcagggacaccagtctttgttctattaaagctttcaactgattggataaggcctatccagtttatgaaggataatctgatttactcagagtctactgacataaatgttaatctcatctacaaaatatcttcacagagcatcccattttgagaagcagcctcactgtgtcgcccgggcgggagggcagtggtgcaatctcggctcactgcaacctccacctcctgggttgaagcaattctcctgcctcagcttcctaagtagctgggattacaggcacctaccaccatgcctggctaatttttgtatttttagtagaaacagggtttcaccatgttggccaagctggtctcaaactcctgacctcaagtgatctgcactcttcagcctctcaaagtgttgggattacaggcgtgaacccccatgcctggcccagaataatgtttaaccaaatatttgggtactatgatgcagtcaagttgacacataaaataaaccatcacaatgtataattcttttaatgaattgttgaatttgaatatttctcagaaatattctttgggttatacaaaattattatcccatataaaagaagaggcagttgaggctaggataggtaatacaactcacccaaagtcacacatgctcaaattggcaggactgatatttgtccctggctccaaagccccaggttttagtcatataatcaattacacagaaaggacatccaatatgctgatacattattcttcagactggccttacttcctttgctcgggagtcacctgcctataactctcatatgtgatttaatcttgattgtttttgttgaattggggaacttcacgaatgagaagtagaggagttgagatttttactttctggcatgagctaccgttaaactgattatctcgctgcagtccacatctggaccaagtacaaaagtgaagcctgacttcttactctgtggtgctgataggaataacagccacaacaccaccatttttgccatcttgctgatgaattgacctcatatttctctacctacatttttcaaaatagtgctcttttatgagttactcaagccccattttaaaagcagtgtggttgataagtatgtttcatacctgcttgtactgagcttttttaaccttgtgctcttgaaataatatgagcttttggacactatgtattcagtacagactttcagagtgaaaatgttgattttcccaaattaaagaactaggggatatggtaatatatgctctcaattttgaattaggtggaaattgacatcgtttgtcagaaatatactgaggataaaaatgaggtaaagttttaggtgctgagctgtgtgccaaatagcccttgtgtttctttcttgaacatctacttcaaagaagcagatttgcctttgatatccctgggagccacatgaatatgaactgactccaattgccctcatcatctccagaatttattttttatttttttagggcatgagtctgtggtcaatttgcttatttgcttctccaaaccagcatgatcattataattctccttttcatgaaataacccactctcagcctgttgttaatcctacctagaggttgggagtggagtcacctaacatgagggcattcatctcttcagtaagtggtgtgcttgtgtcagaaatttttatgcagacaaaaacacaggaatcatcatggcaacagaataatattcaccacctgagccaccttgacatttctcagctagtaggaagctttcttttttcttttgtgcttttaacatagaagaatgcctcctaagttttgcaggctacatagtcatgcccatgagcctcctcttttcaatgcatcctgcccccataaccatttttctctgtaagtgatgttaactatgcagaaagccaattaggagattctacttagaattccttctcttaactgtttctcaaagcttatgtggtataactgctagaaaaagatgtttgaaaaataataatatattctatattggccattcaatgtctcaccttcatgccttagctcaaactggcaagcttctttatgccatctctacatgtagaaaaagtctaccgattccttaaaatcccatccaaaggccatttcctctgtggtggtttgcctgtctcacctccttagcagtcacggctctctctcatgagtccttttaacactttaataataactaataattataaacacatggatcattctttaggttttacaaagtttgttgacacatcatttcatgtaacaaataatcttgtggctttgattatattctccatttttattctctttctctctctttatttatttatttatttatttattttttgagatggagtcttgctctgtcacccaggctggagtacagtggtgcaatctctgctcactgcaacctccatctcccaggttcaggtgattctcctgcctcagcctcccaagtagctgggattacaggcatgcaccaccatgcccagctaatttttgtattttcattagagacgtgatttcaccatgttggtcaggctggtctcaaactcctgacctcagttgattcacctgcctcccaaagtgttgggattacaagcgtaagccaccatgcccagcctatattccccaacaatggagaatattaaacaaataaacacaggagggttaagtaattttttttttcttgagacagagcctcactctgtcgcccaggctggagtgcagtggcgtgatctcagctcactgcaacctctgcctcctaggttcaagtgattctcctgcctcagcctcctgagtagctaggattacaggtgcacaccatcatgcccggctaatttttgtatttttaatagagatggggtttcaccatgttggtgaggctggtgtcaaatcaaactcctcacctcatgatccgcctacctcagcctcccaaagtgctgggattacaggcgtgagcccgtgccaggccaagtaatttgttaagtgacacacagctgtcctctgtcttctgacatcaaatgtcttcctgtgctagctatatactgttggtctcaaattatcattatcttagccaaccgttctggaggacatctgtgtgctaggcattcttctaagtggtttatatgcagcagcagtaatagccaacatcttcttgccagatatccacttagtcttcaaagcaaccctatgtaatagatactattattattccaccatttagaaatgaataatctaagggacagggaagtcaagtaacttattcaaggtcagataactacaggaggctgctgcaagtgtcggtctttccatatccaaaatctggtgtcttagtcagtgaaaatgctgcaaaacctcaaaattgacagaggccaccctttagacataattgctacaggaatattgatcccatctcctcttgtatttcaaatcttcagagtgcattccacagccttttgcctgtggtatccaagaccatagaggcaagaatgtctgggaaatgtaggtgttagattgccagcctctgctgggtaagatggcagaagagcatagaggaaggtaaaaatgaatactgggtaccagtagacaatatctagcatactcgtgataatgatgtaagactactgccatttctttagaatgcgatcctggtgagatggccaatgaatgtttagtcactcagatatgcagtggtgtccccctaccactagggggagatgaacaaccggcatagtttgatgtcttaagaaagattatttgttcatgagtaatggaaaaaaatactgagaaagaagtggttgctttctatggcttatgaggagaagcttatgctgtctttaatgaaaaattaatcagataaacaaatgtccagaggaatatatccagatgtattcctatttacagtcacttagtggatgtgccagcatccaaatgcttccttaatctttcaactatctaagtaatgattgaatagaacctttgctccacctttcctgcttaaatgctactttattagcattacttcttgtccataaccatcattgcctaagtgctctgcaacttacctatttaaatactggatagattgtcatcagttcctcatctgaccaatcatttgtttcaccaattacttgcagattctcattctcgtaatggtcctaccatggaactgttgcatctccctgttttcctcaccacctccagctaatcagggtagagtttgctctaatgagcttatgtctcaggagggcaggtctttctgtgaaaaactgtcaaaactcttctaatgggaaacaaatattaatgtaaatgtaggcatttatttgccaaaagagtagtagctcaagaattgctagcaataattaccctacttgccagtgtattgtgtcttttttgattattcctctctttctatgtagagacctgcctaaaatatctcatgaatttttctccctcaagtgtgcatttgtgaagtttctcgaaagattgattggaacacaaggatttcagtttgtggcgtcctgttaatcaggtcagatttgttaaagtcattagtgttaaaaatttctttgtactcacaattctccttacccagagttagttctgtggcagtgtattagtgtgggcagggtatcttccatcaacttagtgtttttaatggagcttaccagagttaatgacagtggcagtccccccagggaaaacaagacagttggctcagatgtcttgtgggagctgaacctgctagaatgttcttctgggggtttcatcactaatctgccaacaactggagtctgtatcctattagtttctattcactgaagttgtgagatgccatgtactttctttttccagtcatctcatttttctcatcttctaattcgtgaaagggacacagaaatatttagaaaaattgggattctgcaaattgtgagattgattttcctatgttcatctcatagtgttcagattgagataaggtactaacttcactaagctcttaagttgtccactataagacaaagtcaatactacttccttggaaagaaataaggccatgatgagttaggttttcaccatgtgtaggttattctaagggtttcaggtctaatggcatcccctgaggtagtaggtagataagctggtcatcaggttagagcctgtattttgaatcaattcatgtgtagtccttacgaccattcattctacagattctggtatctgcccacctctcaggcccctctctcattgcgccctgtacccacagtactcatgctttgcccattctgaatcattttgaatcctaaattatacagtatactttatatttaatacatttctgaattttcaagtgccagctcctcccctcatttacctggtaaactccttaccttctaggtcttttctgattgtcttcttcttgttggtgtgctcaggttcctagtgtagcttatacctgattcaaccagaacacctatagcaatttattgccatcacttttgtgcagagctcctcttatataaccataggcccctgaaaggctggaccctctttgcatctcaagtcttcttcttccattccctgcctgccattagtggtgtctccatgcaggaagaagcatatccaaaaatattttaaattatgtaaatttcaataaagtatttatttcaaccctcagagaaaatgagatcagatttgtacagagatgtggttctcctcaattgtggtaagtttaatgggtgagaatgctgagcaagatttgcattgcatacaaatcacaggaattaggaccagtgattggaaagttcaaaggaagatttaagctcagtataagtaataactttctgggcattaagactgttcaaaaatggaatgtgctatcttttcaactagtgaggtctcaatgactggaagtatttgtaccaagactcataaggatgctatcatatatgttctcatattggtttggaagagatgcttggcagtatcttttctaatcttaagattctatttttatttctgtaaatcagttcaaatgttaacttcttataattgccaattatggcttttatattcatcattattcatttgatattcatcatcagttaaaatttttctattaatcagtcaatgaaaaaattatcttttgcctcactcttcagtgaatctggctgtccttggttgtccatatttcctttcacttctttctatatacactataaaattaatgagacttttaaaaatctttcaattttagtcaataaatatttgaatgttgggccagatgcagtgggaggtacaaagaagatataacattgattacagtagctagtgtttatcaagtgattactggcattttacatatatggactcatttgtttctcacaataatgctatatggtaggtactattttcccattttatagatgagaatcctgaggcacagaaagattaattaattttccaagatcatattgctcttagatggaagaacacaagcaatctaacctaaaatctgaaggtgtaaccattaagcattactgcctcttgatgaataaatttaataagataccatctcttgccttcaaagatgattccacctggtagaattacatgtatttattattcactggataaggctgttcttaattttacttgttgtaaaaatttattctttcaaacttgtctgcattgttatcacttgatagtgttctggcactggccaaacaaaaatccatgtttatctaatttacaccacttatgatattctaaacttgctgtgtaactatatatgtctagtttgaactcaaggtgatatgattgtatctccatgattatgttaattatccttccctgagacttctccatttaccttttgcttttgtggaaatcacaacagcatacaataatccaatgacaaatagaccttttgatttggatatagccatcgttcccacgtattaaatgcatactacatgcagaatgtctaggaggaagtagaagatacatacacccaacaaaagataccatgttagaagtacaaataaagcgatgttggacaaatgaagtgaaattagtagtcacagaaatgagattcaccaatatgcctttctgagcatcttcgttggtatttgttttggagtggtcattatgttggtaatctcacagtaggcaggtaataagttacagtgattcttcccaatcttgcctgaacagactcctcctgtaaacacagctgaaaccctagaaagtataatttagaaaagcaatttttaaattttaatatgcatcagattaaactgaaagatgaggtaaaacaccaattgatgggccccagccccagggtttccgattcagtagatgtgaggtcagtttcaagagtttgcatttgcactttgaaagagctggaataatactaagaatatgcataactcctgggtgtgcattagaatcacctgtgattctggtcacaaaaacaatcaccaaacttctaaataaagacccaaagctcttctaatattaaaccctgagataaatatgagctgtatatatactttaaaaagatgaataaaataagtaaaggaatcatttacccaatttttgatgaatacgtgagtggcagcagttgcggtggtaagttaaatcaggaataaatgtttgcaaagtgaaaattgtaagaagcatctcctcttaccatgcagtttataaacaatcacaaatagggcaggcttgctgagctccttcatacctggcgggttattgtcatgaatttgtatgattattgtgtactttacaaatttttgttttacaataatttgtatttattcattcattcattttccaacccatttattccagctcagccgtgaggatggctggagcctatcccagctgcttagggtccaaggtagtaaccagcctgggacaggatgtgatctcatcacagggaacacacacacacacacacacacacacactcacactcagtcagattgggaccatttagacacaccagtgaacctcacgtgcacagctttgagaggggggaagaaactggagttccagagaaaacccacacagacatggggagaacatgcaaactccacacagacgttggccctggcaggaaattgattttttttcttcatgaacataatgaaatgctgttaaataaaatgatgtcgttcaaggacttgctgtaattaattgaggcttttagtatctccttttccaattatgttttccaattaccaaacattgctcatcacataatagatgctcaagtaatgtttgttaaacaaatgaatatctcttacgataaaaaatattgcaccaggtgggttgactgaccagatatttctaaccatgctggaatgacttatttctgacaaaaattattaattttattgatccaaaaggagccatgtaaaattgttttcctcttcttgcttgctattttcaatttttccaatttgggctcagctagcagtgccacagctgaaaaaagtgcatggattttaataaggactcctattgctgagaaggataataagtgagtctggagggcagggtcatactctcaaagcctttctgatgggagccaagattaaaatgcacagcaggctgagagggctgggaagaagctatgatttctcactgtggatttcctcagagtgccattagtgtaccaaggagaacacaggggagattgcatttacatgaggaaagcaagttagagttcagtgatcttgaattttttggcattatttcaattatttgttggaataatttaactttggcccaaaacatgtgtcttagtattgtatagatttgcagggcacagaatatttctggttttcccctaatgattgtcatggaatgcccttaaatttaatgaataagtgaatcccaagacaatggtatagaggtctctaattccaaacagtaatgtatttttgtgaaataaacaaggctcagtatttccattcgattcggtggcattgatggaatctgagcacattgggcacttcacaacacagtcatattcttattcaatcttcattagaaattcatgagataatcattgtgctattaacctcattatataggtgaggaaactaagtcactaaaagtttaaatgactggtccacatgaaaacagctgatgagtgatgagggctgtcaagacatctcaggttttttcttccctggctcaatgctgctctacccagcacctctgtggacaggaactccttttatcccccactcatttgatgagaagtatatgaggccagggaaaggcaagtgacatggccaagggcaaagggcaaggcattgtgagagtctgttcgggaatcacatctgaatctaaggagaaatccacatcgcctgccatcctaaagagatttcttagttgctccccctcctcattgggtctgtggtgtatttgtgaacaacagctgcatttgcaagtagccaggacttcctccagatgacatattgcgctgccagagtggagacaagcggggctgacttcacaggccaaagagggcatctgcatttgccactcagccccaattattcgaatctgctcatggcaggaggaatggtgggtcccttaggcacagaggccagcctctgatctccagactctctcatttctcctagatccgccccctcatgttgcttaagcaaaagcagggctaacccccgccccttggacaaggggcacatcattcctgcattccccaagcactctctggctgctgtatcagcaattggatgcttgcccaggctctgcaggactctagagtctagagcctgctggcccagaggcaagaggggtgccagatgtgcgagctagcaaaccgcggaagctactgtaagattagagtggcacagaaatagtcgggaaattaccctttccattgggcttggaatccagggtaactgaggcagcaaacaaacttctgtgtgtgtgaggtgtcccagtgtaccagtgtcctccattcgggggtgtcttcttcttggaaggaggactttttcttttaacccctaaagtgtcagggatctaaaagctggttggcaatacttgatgcctaaattgtggcctgggggtcacgatctcctgggtgctagttagaaatggggaatcccctggcccagtccagacctatggaatcaagatctgcattttaacaagatcccaaggtttatttgcatatttgagaaggcctgccctaaacaacactcatgagcctggggagaatcttaaaggcttgtgagacaacttgagggttgtgacacttcctaggtacttttgtagcctacactggtcctgtgtgattgggatctacgtctagcactgggtctgtggcgatactaacttccctgtctttcctggcccagactgacatttccaaagggctgcgtgaggtggtacatactcaggcaaggcattaacagtcacacaggcgctccagggctttctcctggcagtgcttgagccacgtggccctccatggagcacctatctctatcttggaccttttagttagaaagccaacagctgccctgcgtgggggaactgcacagtatgctaatgaaggagcagcatactgaaaatgatgttgtggctattaacatttttatgggtggactgctttgcaaagcatagggaaagtattactcttctaggattaatatatttaacaaaaagtctgccaggagaggaggtttttgctgataaatataattctgctgttgatttatttagtaatggagacttgaaattacaggaatcaatgtgtatatggaagccattgtcatttggttaattatgttttgccagcaggatggggaagcactttatgctcgatgcagccaaatgtatttcagccagaatcctgtgttataaatgacgaacacataaatgtagataaagagaaagacccctataattctagattcctggacacttgatcctccagaagcttgacatccctggccccctgcactggggctgtagcatgtagcataagtaggtctgcttcctctatagcaatactccttaacggggcttattttgcacccatgggatatttatagatgtctggagacattttgtttatcatagctgggcagggaagatgggcaacaagagagtagaggccaaggatgatgctgatgctaagtagacctacaaagcaaaagatggcccccacccccacccctaatgaagaattatttggctcaaagtatccatagttctaaggttgagaagccctattctagggcattcctatttgagattctgactcaaagaaatggggtgaagtccatattctctttgttgacaaataaagaaaataaggtgtgggcatcacatctggttatgtagtattatcttccaagatatccacccaggatggagtcaagatgagtgtatagtaggagagtctggaatagctctccaaccactgtcacttatctgaagaggtctaacactgtcaattggtcgccatcctattgtgaagatcatccccaaccttcctttccctacattctgatgaaccagctgtggtttggaaggcataaactttgctacagtcacagctgtgctatttactgagtgatcctgagagtggtaggcagtgtaatggccctcaaagttgctcacatcctaattcctggaagctgtgacctttcatggcgaaggggacttgcagatgtgatttagtcaaggatcttgaaaagggaagattcccctgaattttctgagggggtccttgtaagtagaagatgaagacaggggagtcagattcagagatttaaagatgcactgctgctgatcttgaagatggagtgaagctgaaggaaggagccatgagccaggcatgtgggaagttcctaggaaaaagaaaagacaaataatcagattcttccctagagcattcagatggaacacactcctgctgataccttgattttaacccccaaagactcattttatacttgtgatctccataactgtaagataaaagatgttagtggtaatttattacagcagcaatgggaaaccaatgcattaaggaaggcatttttccttttgaatgtcccactataaaatagggctttatccactataaaataggtgttgctcatttatttgttcctttattcattcaacaatcatttattgagtgcctactatgtgtccaccattctaggcacttgggagagagcagtggaccacagagaccaagcaactcctctaatctagtgacaggagactgataataaacttccaaaaaaatacagaaatctacagtgataaatgttatgaattcaagtgaagcagggtaaggcaaccggagtccacatctatttcttacaaatcattcagagcaggttctgtgataaggtgacatttagcaaaaacctcaaggaagtgggagagaaagtcatacagatattcaaaggaagaatatttttaatagaggaaatggcaagaatacattccctgagctaggagcttgattctgagattcaaagagcaagggaaccagtgttgataatgataataattacctcacaaggctggtatgagaattttgggcaacatacatgaaaccccctggtgaatttcaaaacactatgcaagtatttagtcatcattgcatggtccctcggagtgcattttgggggctgccaagggatgtgtagggtgacctttattttgtgtctatataaaagcgaaagggaaatagctattggcctcaggccatggaaattatgcacagaggcctagaaataggagtattttcccaacatggagctgatgattgatgatgattctatgtgtgtccttcacagtggcaaaccttcaaggggcagggacatcattgctgctgtagtccttaaaccctgtggtccagaagggtgctcccaaggtgccaaagggggcccagagcagtcggcttttctgtcatgggggcatacaaagagagaaatcatcaagaaattcaaagacctcaactcctgcctggccagggcccagagagaagcagttaggatagcctctgatacccagccttgccagcaactaatctgccagatgatgaaattgaaatatttgaaatataatccatacattctttttccaagacaggtggtgaaatggtctagtttttacaaaaggctgagaaaattaaaatactaaaatgttgcacatctttgtgtttgggagtaggacttcccctggaagctggggtggggattagagaaggcttcccctggaagctggggtggggattagagaagacacctctcagaatctagagctggcccattaacaccttaggtttaaggagctttctcagcccattttgtatttctaatcttaaaatgaccaaggcaaggtcacagataatatgtgtatttcatccttctttatgctgaagaatccgcttgtaactgaaaggtattttgtatattaattggattatcaggttagattctttttcctaaatgagtttctttaggccgtttctgcttgcttttaaaaaactttagttttaattttagatttaaatggtacaggtagaggtttattatatggatacattgcgcgatacggagatttgggcttctgatgatcctgttacccaagtagtgaatacagaaccctgtaggtagtttttcaagccttggcccccttcctccctcctccgttttggttgacagagtctgcagtgtctaatgtccccatctttgtgtgtgtgtggacccaatgttcagctcctgcttgtaagtgagaatatgcagtatttagttttccatttctgtagtaattcacttaggataatggcctctagcttcatccgtattgttgcaaagaaccttatttcattgtttaaaatggctgcatggtattccatggtgtgtatgtgacacattttctttgtctaatccactgttgatgggcacctgggtggattccatgtctttgtgagtaatgctgtgatgaacatactagtgcaggtgtctcttggtatatactcagtaataggattgccagctgaatggtatttcacttttagttctttcagaaatctccaaactgcttttctttctttctttctttctttctttctttctttctttctttctttctttctttctttctttctttctttctttccttctttctttctttctttctttccttctttctttcttttaattatactttaagttctgggatacttgtacagaatgtgcaggtttgttacataggtatacatgggccatgatggtttgctgcacccatcaacctgtcacctacattaggtgtttctcctaatagtatccctcccctatccccctgcttcctaacaggccctagtgtgtgatgttcccctccctgtgtccatgtgttctcattgttcaactcccatttatgagtgagaacatgtggtgtttggttttccgttcctgtgttagtttgctgagaatgatggtttccagctttatccatgtccctgcagaggacatgaactcatcctttttaatggctgcatagtattccatggagtatatgtgccacattttctttatccagtctatcattgatgagcgtttgggttggttccaggtctttgctattgtgaatagtgctgcaataaacatacgtgtgtatgtgtctttatagtagaataatgtataatcctttggtaatataaccagtaatgggattgctgggtaaaatggtatttctggttctagattcttgaggaatcaccaaactgtcttccacaatggttgaactaatttacactcccaccaacagtgtaaaagcattcgtatttctccacatcctctccagcatctgttgtttcctgactttttaatgatcgccattctaacggcatgagatggtatctcattgtggttttgatttgcatttctcttaatgaccagtgatcatgagcttttttttcatatgtttgttggctgcataaatgtcttcttttgagaagtgtctgttcatatcctttgcccactttttgatgttttttttttcttgtaaatttgtttaagtttcttgtagattctggatattagccctttgtcagatggatagattgcagaaattttctcccattctgtaggttgcctgttcacagtgactgaactgatttgcattcccaccaacagtgtataagctttcccttttctctgcaacctcactaatatctgttttttttaattttttatagtagccattctgattggtatgagatggtgtctcattgtagttttgatttgcatctctgatgattagcaatgttgagcttttttcatatatttgttggccacttgtatgtcttgttttgagaagtgtctgttcagtttctttgcccactttttaatggggttatttgtggtttttttcttgttgacttaagttaatcttatagattctggatattagccctttgtcagatgcatagatgtaaatattttctctcattttgtaggtcgtctgtttactctgttgatcttttcttttgctgtgcagaagcccgtccgtttaattcagtcccgtttgtctatttttaattttgttgcatttgctttggggatcttcatcataacttatttgcctagtccaatgtctagcagagtatttattaggttttcttctagttgttctctatttttttgataaaataaatgcctacattttgcagaactgaaatattaatgtgtacatgttattgtctgagtaaactttgtttttttagactcatagtaacaaaaggaaaatagacatctttagcaactctttcagtaacagaacatcttttgtataacctgaacttttatgtcagttcaggaatataagaggaaaagaaaggaaggcttggcaagataggtagctccctatcaggagaaacgaaaatgaaaagaccgtcggatcagtgtatactctgagttctgtgggagctgagtctgtatcctagaaagcatggaaaagtagtctagggcagaaataaaccaggcatgctgccaggatgaacaactagaaaaaccctttggaaccatggtctgtcaaatgctgatgtgcaggcagcttcctctgtccccaaggtcagaagaaattcctatatcgctacttctttcttctcctcaacatctgaagcaaaaccctacagagtacaaaggtaaagtgaagacaaaacaagtccttctagcttcaaaatgctttgatattctttgtcttttattttcataagacttgatagcatgttaatgccacagaatagcaggattcccttccattatatgataaacatgctagtgaaaaagaattataaaaaaaagttttaacagaggaattatggcaacctatgagaattgcttcaagtggaatatatattcatgtattcatcaaagagttgtggtatccactagatgtcaggcattgagcaaaggattggacaaggggcaagtagggcaaggccctattctgggctcctggaattcataatataaatggcagcatagacaaatatgcaaatgaacaaatatgcagttgagttacaaattgtcaaaggtgttatgaaagaaacaaacatgatattctgctagagttatgactgacaggtaaagggtgagtacccaggaatggccttgctgagatttaatctgagagctgaatgatgagagggagccaagtacattgttataggtcagaaacagaaacaatttttactctggctcttctgggaagacatgaaagcctgtgtttacaaaaggagattttgacttacctagtcacatgatctaaagaaacgcttttactcttattcttctaaagcgacatttcctggtcccccaccctcctgaccacatttcatattctttttccctgcattatttttttctccccaggtattataaatatatgacatactttttcatttactaatttgcctggtttaatgtctgtctccaccactagaatgtaaactctataaggaacttgtttcatccattttgttcatgatggctgtctctactgcttagaagagtaaccggcacatagtagatactcaatgaatatgattcctgctatactaagctatttctttttgcccctggagagggagatatggaattttgaaaactgccaggtctggaagaatatgctatactttccaaggttgttagatttgaatgagaaaaatatacactaaagtgagttccatgctggtgtatagtaaaggctgagtaaatatcattcttgggtacttccctgtctcttttttcctaagcacactcagtgaggtgggagctgtgaaacgttatgaggtaggagaaggtgatgtctaatgtttctctactgccctgttggcgccccccaaccaagtatctctcagtgcctttgcccagccttcctctgcacacactacagctagctctatcatttcctcatgccccatcaagtcctacctgtcttcgcagaccctcaggttccttggctgtggcttacaagggacatctgattaatctgtaaccaattcatgttgatcccctagctgattgcctctttgtcaccatgaggccagctccttaccatgtgtgggtgcagcaagcaggtacaccatcaccctgcttgtgggatcaggctccttctcccccggacagtgatgaggagacactgtcttcatttgcctctttacctttcccattttaaagctgttgactaacttcaaaaagaatctttttgaattccttttactcatagaaagcagaacaatggaatagtaaggaagaaaagagaaatcaaggctgcagaagagaagacagaggcacagggagagcacagagtagagagtaaggggtaagagaagagaagacaggagaaaagagaatgaataaaagaacaagagagaagagaagcagtgggtaaacagcctgttagatggtggcatagcttttacccactgaaaagatgttcacagcaaggtctatcaaaaccctaccacagtatagcagctctaccttgaaatagtatttctaatgataaaaataataacacaataaagtttagtaaacagtatgctaagagctttgcatatgttttctcctccatgatccttttgattgaaggcaaattttgtcatcctatgctcaaaattcttcagtcacctctcatcttactctgagtaaaaggatggggatctgctccccaccctttcttccaagtaggacccgttcctcagccccagctcagacagtatgcccctcccactctctctcttgctccctccattccacacacactggtctccttgctatttttgatcaaaccaattgtccttcctcagggcctttgcactggctattgttttgcctggaagagtcttctcttagatgtcctcctgactctctcccttacatcctgtgggggacttcttcctttgcttcttaagcaaaagtctcccatggccaccccctataaaatgtcagcccccactaccatctcttcctcctgctagctactcccccactttgctttaattttctccatactacttatcaccaccaggggtataatgttattttatgtcaattgtttgtcttttgcctccagattatgagtacagggattatgtcagctttcttcttgattcatacatcgtcggcacttacgcctcgaaggtggatactgtttttccttccgtagtagaggggaaaaagtaagctcacaccaggtaagtaaattttccaaggtcacagacaggaggtggtgaagccaggtttccaacagagctgtgtccatgtccaaggcccatgctttcaaccactgtgctagaggattccccaacggctttccacactgttaggacacctgtccgaaagggtaggttggcatttcaggagatgcctttctgtgctcagtcaagatcaatgcagatgtaattgtgtaaagcaagacaggactataaggcagatataactgcgtaaagcaaaacatagacttataaggcaaggttggtacaaatgcacatggctaaagcttgacctgtacgatttactttggctgcaatgcacagctacagaggcagtggggtatggtgtgtggtggttaaggacatacgttttgtgagatagatgtggcttccaattcctacggtgccactacttagttttgagaccttggccaagttacataatgctcctgagcacccagttccttctacatgaaatggggctggataaatggaaataatgcctacccttagagttgacttaaaaattaaataagggaatgtatacactgttcttagcatagtccctggctcatgtaaatattcaataaacactaaataaattactattattataattattatgacgtttacttagtatatagacgtagagaaagttttagttgaaattgtatctgttaatacattattattttctgttaagaatgaacatctacatttggaaatagaacaaaaaaagagcttactgcatatcctttcactgtcatgccacagcattgtctaatgagccgtcctaagggtcatctcactctgtcagacaatgtaattttgtttggcttaaaattaccactgattacagtctagcctctgcaaagttgatgttagcatgtagaaaattaataagatgcaaatcactgctgtccaatagagaggcaaatgatttctaacaatagagaataaaacagtagagaataaaatgttaggattttattgccctttagactattaagcagttttggatatatgacttaaaaacgttattccagcagtcttttccccatccatccattcatccacccacccacttacttacctacttacctatctcagtttcttgcattctccttgaatccactttattattttgttggttcctttattaatgattttaatatatctttgatacatccccctatgtatttgtatgagaataagtttatatatatatataccaaaatacaatacaatacttacataatatagatgtactcctagaaagcaattgatggtatctaagctatttaatcttggcaaaccctatcagatacctagtttctgtgctgctactcctgatgatattgactccttataagttttactgtacttttgcttactaaatatcagaaaggtataacatagtgtttaagatcagtggctctggagtcaaacttcctgggttcaagctcttgctctatctatcactaattagctctatgatcttggaaagttgcttaacctaccaacaaaatgaggccatatgaatacctcttatctcagagaatattttgaggagtaaatgcaataatgtatataaaagtgcttagcatggtgcctggtccatggtgtttaataagtattggttattatgatttatgattgatcttcattttggaacttaataaagaaaatgaaactttgcaattctattgtgaatgtttgattttaatacttcctcagcaaactccggtagtaattgcataatacgacaactgtttttcgtagaagcctaccaactagaagttctgaaagcaagtgtttaccatgaaaggtgtttaactcttagagagccctacaaattaaaatagcctacacagaatacaactgaaaaatggcctctactgtttattttctaactttctacactatggtacagagataacttattgtttagtagtgactggtctagtctgttttattgacttgtgcactttctgaccctgtctaatttagtgtcagagatcacctgtgatttttgtatatttccgaatgtgtaagtatctttcccagtaacttgtacattctgatttcctttgcacatgagaattgatgtggaaaaggcagctgagcagaggttggcaacctttctgaagtgctatgccaacttcccatttattcactctaatttaaggttttccatgccaggatgaacctcctatcatccaaaccactggagactgagaacttccaagacagagcaaggctacagaaattgaaattttcattgtatgatagattttccaactttttttctttcctgaaaaccaagaactttgaaaatgctgatgccaattttatgcaacccagacagaacgatcatatatgtagggaaggggttggtgaagattgcagttccaaaacctcctgaagcttttcatacaacatttattcattcatgcatgcatgcctatatatatatatatgcattgtgcattcatttagtaattcattcattaaatcaatgttgagcgtctaacaatgtgccagccactctggttatgtatttacatatacaatacttaacttttttgactaagtgagagaacatacttcatgcacgtagcagagtgcctggctcatagtacatactcagtaatgaaaaccattagttttaatcttctgtttaaaattttacaaaagtaataaatgtacatagtaaagaatctaatagtgcagaagagttgaaataaaaagcagcaattccccatgctgcttctgttttctcccaatcatattctccagagccttaattttaaaaaaatcagttcttctgatatttacatatgtaacattaaataatgcaagtaccagtggtgtgtatcctcccctagactctcatagggaaattctctgcttgttcagcctaggttcaccttggccaggggtagagttccctcttatcacttttctaatgagattcttaaaagtgtccatgactgttgaacaccagacttgttgtctaggggaataaattggcgtggaggagaccactctggaggacagctcatcttctaagtcctttttgcatgcactgctttccagacctgtgtggaaggcaatatccttttcatcccttcagaatttcttctctcttcttgttgcctcttgcttttcttacatgtttctctgtgttctgggctttccaagaaaaaacaccctgaaagcctcttagtctggctttttgaatttttgttttcccccttggtaaggactgggggtggtatggcaagaggaaaatgacccaaaagatttggagggaaatgcgcagaaaacagctagattaatatttcaagatagaaccatcctgatatattttcttattttactattctttgatttatcaacttcagacattatttattgactcctctctataaaaaaggaggatttatctcatgcttctttctatctgctcctctccttcccaaagttggatcattatgttagcattttggttcttctgttgtttctctttctaggtttaaataacaaacttagatctctttgcatcaccttgaggcagtgtctcttgtctgtccagcaagatgagggtatttgctcccctatgcttttctcccctttttcattgtcaaggttgctagtgttctattctatagatgtatttaaagtttctaagttttatatatagatagcttgactataaaagttgaaaaatggtatacaagatttattttataatgtcgcttagaaaaatttgaaaattgactgtgtattagaaattattcactcaaatgcattattcatgtaacatttctgttggttttttttcaacataaaaatttcaagagaaaacctagctcatttcaaaatccagattttaaaaaggttatttttgatttttattttttaaagcaacggggtctccctatgttgcccaggctggtcttgaactcctgggcttgagtgatctttccttctgagcctcctgagtagctaagatgacaggcgcacatcactgtccctagcacaaaatccaaattttcaaacaagttttaaataggtaaactttatcatgcttttatctccctcacaagatttactaagcattgggttcaaaaagaaatatttaagctttaatttttaaaggaataactactgacagttaataatattaagaaaaagaacatgaaaatgtcttttgaatgacacattttaaaaacattagtttgaatccgatttcttcagttcaagtgcaattaatagtctaataaaagaatcatcaataagatgggtaaatgtgtgaatcatgtcttagatttttaaactaagacaagttgaaaataaacacattttctggcttcatagataagccttgtgttatatcaactctgtgacatagattaaaattacaataatggattaaaagtattattttatctcatctaagacatgtaatattagtactgtaatgtcttttagtacttacactaatatatgggctgacagtggtgaaacaaatactaggttcctgaagctttcctaagcattataattctgatatatgatcatattattttcaacaccacatctcaattttctgacacattttttacttttataattctaggatttgcagcatcacattcttctctaactccttgcttatgtgactaagaaaagtgtttaactaagtacaaaagttcagagtgtaacttagtgttaagaagtaagccagattttgtcccagatcttacatactaatcagctttcactgagagattaatttactagaatttcttttgagtgtgcgtgtctccattcatacaaagattcggctacatttttcttttttgtgtattagctttgtcaagtttggcattaggcttatgctggttttataaaatgaataactttctatctttttgttcagcctgggaacaaattatgtagcatagtcattttttgaagatttcaaagaacgtttttcaaagaaatgtgtgggcctaaatatccttttggaaatatttcatttataacattttcaaacattttcataattatctatattgttttaaactccttcctgagtcagttttaaacacttgcacattcccagaaaattctctttttatctaaattttcaatttttttagtataaagactatatggagatctgtgatatactttaaaactactataacttttttttataacttctaacttgttttgtgctttctttttttgtctttgttagagtctccatgtttgcccattttgttcgtttttctgacagcctagctgttgaatttatttgtccactttagaattaaaatattgccaaatttattcttataattaaaattttttcagagtttatgagaagtaggataatcatatatcccagttgcctggcatattctggtatatgccttctatcccaacgtaattattagtagtactctctttcctccccaaaatacatcagttgggtaataaattatgtggccactctaatgataagtgaaacatacattttcctctcaatacaatagcaggctataattacaatgcataattataattacagatattgtctcatcccctgggatgtgaaaattcatgttgaggaggttggggtgggggaaggtcaaaaggcttttgatattataaatgtttgtggccatccgaagggccatagtacctaagtagataacgagtttaactgcagtatcaaatttcatgtgggagggggtataagtaggataaaattgtcttaaccaggctccttagagggacaataatgaaaaaagaaaaggttgagaaaaatgttataatgctgtttgaataccaccattgattagttcattttatttttctccttaatagtcatttggtgttttctaatttgtaagtaaatatagtttctgtttaaacaataagttattgtttcaacactgaaatacccttgttgacatcatcagtggtcaacattgtcaacacattgttctgtgtttttggctgactctgcttttcaataccgtctgtccaacttgactatttcctccttttttttttttattgagaatattattgggctcataggattaaatgaaataagatagtaaggcattcagaactgtgcctgtccctcctgctttccctctgtctcactggttattttcaaactttttggtttccttttttttttttttttttttttacctccggccaatctctaattgctggagtgctaaagagcttgagctctttttcttctctatctgcattttattcctgaatgacctaatctaattacattgctttaactccttctgtataactttatacctccagccctgactcgtaccatgagcctctgacttgtatattccattacctgcttgatatttccatgtggatgtataataattatcagaattaggtacaggctcaaaactgaatttttttcttcacatctgttctacattcctcctcgttcctataaatggtattgccattcactcagtttcttaagtcaaaaacctaagatgcattctagacatttctctgtctgccttcctccacattccatctgccatcatgccagctggttatatcaccaaacctgtccacttctcttgattttccttgttactctaatccaagacaccatctgctgtcacctacattctccactggtctcctgcttccactctcatcttccagccctcaccctcatcatccattctccaaagagatctcttaaatatacaactagaattactccactccccttcttaaattctttattgggctttcactgcagtcagaataaacactgaactctgtatcatggccaataaagaaccatgctcccatctcctctccagccaccctggccttctattcccttaacatgcctaaccagtttctgtcatgggcttgcttgctgtttcctctccctgtacgttcttcgggcccacgcgtttctgtggctggccattcttgtctgagcagtctcagctcagttgccaccccttcagagaggcttccaacctggcaccataactaatgtcagctcctttctaccaatgattattgagttgccctgcccaacttttttttttgtcaaatcattgttcgtttgttttgaactggagtgtttattgcagaaatttggccaaggttccaattgagtgactccagctgaggttagactggggccccttgcccagggctgggcacctgagacaggaaacagtgaagggatctgggcctcagagctgtgagatagaactggggaccaggctgcaggtgaggcctgtatggtcaggttcatgcaaggccttcaccacaccatcctctatcaccaggaagaacctctcaagctctcatcctcaaagagtggcaacagcaaatcatctagtaacaaatcagtctccttcccagaggccccagggctgccacccatgagctggccttggccttctgcactgtggcctgtccccactcaccagtcacaaagacacaaagacagtggcacttaaacatggatctggcccccctttaccttcagaaccccagcctactccccaaacccaagcaggtgggtctttgacagttggggtgaaagccccagggattctaaacagcacacccttctttccctggcatagttctgtcaggtccaccttgttcccaggctccctttcaaacaccactaatgccaggatagcatctcccaccatgacaggtgccatggctgcaaagttactgctgaaatcgtgggtccccaagcatccactctccttctctttctagtagtcacgctgctcctgctgctgctgttgctaccactgctcctgctgctatgattctatcatagcagccccagtgaggaccaacccagttcaatgtttcagggcgcacagttgtgccagctccaggctgggccctgtggctgcgacagtcctgtctctgtggttaggcaccacctatcctattcagccttcttagggttatcttagtatttggtatagctccttcttttctgttgtcctcccagcgctatcatgtcagttccgtgaaaaaagagacctgtttcttcattcacaatgcacatgttctcagtacctggaacagctcctgtcccacagtaggtatttgtgtgtatattttatgtaatagatttttggcttaattctcatggagtcaaatgatgaatgtgaaattcttaaatgctgaaggtttgctgtatttagaagtttttgttgactgatgggttggttggttggctttaaagtgaagtaatccatcaggttttatgtatgtgaacttttatggaatttggtgaagtgtgtgcctgtgtagattagtatataggagagaagtttttatttcttttcagatgattagttatgctttgccagtatttcctcagaacttctaagagtgttggtttggggggatgtattcagtattgacaattccacgtttatctacattcagctgtcaggttggttatttaaccattccgaggcttttcttttctattatggtcacttaaaacaaagtaaagcaaaatgaaactagactgttttggtaagcttttattgaaataagaggggaaaatgtaaggggtaaaaattgctaaattatttgaaattatttttggatgcagaggttgactttattgactgaaacagaatttaagtccttagcatcttatctggatgttaagaattgcctatcttttggttgtttccagaacaatcatgtaggttcctttttgcttagactgaaaatgatttgggatgaagtaaaaaattcactccctcacaatggattaattttttttctcagtggagatgccatgcggtcagaatttcttgaaaatgacccacaagcttattactaagcagctttgggccaatgagcagtcttttaaagaaaacattttatttatttttctaattggagaataatctatgttcattgtaaagaaagaaaatagaaattatgtatattcctaccaaagacaatttccattttagtgtatttcctttcagttctttttctgatatactatcttttctcttctgctttgagatgtgcattgtgacttccctttgtgataaagaggataaatctgctggctcatttccttttatagactgccaccttctctaccaacgaagaaaatgtgcattttggattttgcttgagttgaaacaatttatgctggaacaattataaaaagtagcatctgtaatgtgaatttggcccactctgtatcagaaaaaaataacttccaccatagcccgagaggaaactttaggtatctatcaccgatagagccaatgcttttaatacatatttcatgatcacagctgaggcttttccaaactcagagtgctgtatcattcattcactcctttaaactacaagattatttttggctctttgtgttggcacataggcctttccattgctgatctgcatgaaccatttatcaagtcaagggtttaatctatcaaagtcagagtttcttttttctgcctgtctctgtctcgctttcccagatggtattgtctcatatgtgtacactgttggcttaaaaaaggctatttggaatgcaaaggtttatcaagtttctccattttttttcaaaataatatattatggagcaaagtgatattttataggcaataataattatagtgttgatcaggttctaaaacattacattaactataatgtcccaaacctccttcttggctaatattctggttccgttcttgccagtagctcctattttctctactcactcattctgaaaacttgaatcatctttgattttcctctctcccctttccaaacatttattgaattgtcaaattatttggattgtatctcctggatatttcttgaatccatcctccattgcctttgtgtactggactcatgatgttgcctgttgtcttcaaagaagcaggcaattcattttgaatgcttttgatcggatccaaatataaaggccaaaacaaattaagtaatttatttaataacactgactccttgccgcatgccaacccccgatctagactctggtgatatagcaatgaacagtagggttaaaaaaaaaaaaaaaaaagcctaatagaatttacatgccagtgcaggaacaggggagaaagggacaaaaataacactagtaagtaaattataggatgttggatttgttaatgttgttatgaggaaaagtaaagggatgaaaggctgcagtgagacctagggtggacagggaagggttagagttaaatcaggtggtagggatgataatgaaagttaactaaaacttaaacaggcatcataaacaaagagaatacatcaaaaagcattctaattatgtcagctagtgtcctgaatcccccagtcctgatacctaggatacatagataatgcacagggatcttcggtgcctgagcataacgcaatgagaactattataatagccaccaagctgttctccctctctttgagccattcccttcccaggtcagcactttcagcaaaaccgtattgcggtctaaacataagaattgtgcttaggagaaagtgctaaagttgattcaaagaggcatgtccacaataggtaacccaaggtacgcaagaagaaattccaggggccacagtaagactcaaatcaaaatcaagaataatatttagtgaattcttactgtcaaatgaaaaagtctaaagtctttagcctaatattcatggctctccagaaaatagcttaatgctagttttcttttttcttttctttttctttttttttttttttcatttttgagaccgagtcttactctgttacccaggctggagtgcagtggcataatctcaactcactgcaacctccgcctcctgggttcaagtgattctcataattcagcctcccaagtatctggatttacaggcatacaccaccatgcccagctacttttttgtatttttagtagagacagggttttgccgtgttggccaggctggtctcaaactcctgaccccaggtgatcaacccgccttggcctccaaaagaccatgctggttttccaaccttatttcctagcactcatcttcacatccttccacatgtcttccaatttccttccttgttgtctttatttggatggaagatcttctaccacatttttaggttccaaattctatccttccagtgggactcagatcagatgtttcctcttgtatgaaagcttgacagaaatcatcacctcctctttagaatgttaataacaaactcttttctggcatctggtattatatttactatatgtgtgtgcctcaacatttctgttagactaaagctctttgagggtagccatctggtccggctgttctttgatcctttccccttggcccacacagtgttcagcacagatgagggaatgataacaaagtgctcagtggtattttcaatggcctagtttttcaatggcaattcaaaaatattgttgcactggagtgcctccagatgaaggtcctagaaatggtaaaatgtcatgaaatacctaatcagtcaaagacagggaatgtttagcttggagaagagaaaagtaataataggcaaattttttcagtattcagccccctacctgcctccctgccaacatactacacctttttcattatttttattaactgaccttctggctatattcatcagtgctcaccacttctttttttaaaaaaccattttctcccctcagtgcatagggtatgtctcgaatctctccatctcttttgctggcttttttgcccctatcgaatctttaaatgttagaatctaagctcagtcttagatgccctattctcagttctgattaatcgatgcttgtggcttcaattttaacctacatggtggagattcacaaaagcatacattcaacccaggcaagatgtcagaacttccaactaccaactcaacatctctctgaaaatgcttcagaggacccaacatgtacatatggaactcacgaaacctttccacactttctaattttaatgaatgactttgcagccttccctgtattaagtcaaaattctggaagtcacccttgacagcttcttctcccttactccttataaaaaatccatttccaagcctctagtttttacctcctaatgtatctaaaatctacttagagatagatcatttcctcatataggacaccattgtcccttgcttacctagatttctgcaaaaactaggctacccccatccacatttgcctcctccactctgttcttcactcctctacagttaccatggtgattttttgaaatgcagattttattgccttatttccctgggtaagagtctccgggattcttctgtgccatctctaaactcctctgaatatggcccacaggtctctgcttcatctggacctccctgccactccaacctcatctcataccatgttgctcttatcttcctttggttcatccttcaaacatagaggacaaactgcgtcttctgtctgggatgctcttctcttctgtttccacctatttagatcttttacctcttagatcaatcatcattcccttgaagaagcaccttctgatcttcctgaatagatcaaatccactattagagtctgtactggcatcaggttattaaaatacatattgcaattgtaattttacatttattgctgagtatttctgagagtagggtaggaagaaggagagctgcaagacatgaaacaagagaggacctagggaccagaatatgaagcacttagtaaaccatgttaagacattttggatattatcctgaagacagtggggaaccattttaagaggaaatgacaggatcctattaacatttaaaaaatatagtggttgaattatgtccctccataatttttatgttgaagtatcaatccttttacctcaggatgtgaacttatttggaaattaggttattgcagatgtaagatgtagtaggatgagtaagattagtaagatgaggtcatactgtagcagagtgagcccctaaaccaataagacttgtgtccttatttttaaaaatatcatgcggaaagatagaaattcacacaggaagaatgctatgtgaagactggggttatgtttccacagatcacggaactaccagaagttagcagagaggcctggaatagattcttccctagtaccttcagaggtagcatagttctgccaacacattgatctcaaactatagattccagaactgggagacaatagaatgcagttatttaagccactcagtttctaatactttgttacagcagccctagaaaactgatatagtaaggataattctggctgcagtgtagagaatgttttggaagtgggtaaaactgaatatggtgagacaatttgaggctactaatataagagatgacagcagctgtggaaaagattagagaactaatttgcaagtagaatcaatgaagataggtgaatgattagacttacagagtggagagaagaatggcttgagaaatgatggaggattttaaatcccatttattgagtgatgactcccaaacatacatctttagctaagacttctcttcagtcttccagattcttatatccaaatgccagttaagctacacttggtttttccacagtcgctttgatgaatgtttaaagaaagaaattggtaactaatagttaataagagctaccatatagattacaaaggagaattaatgtattatttatctgaataactgtatgttaaaggaagataaactttcattctacctgggaaagagcttttaatcaaccatagctcccaggaatagaatggaatagaaaacctacccttgtgaggtagacttctgtctctgattacttcatgcagggtctaaatgtccataagtctacaacttcagcctgtttatccttctttttttcattcacatggttctttgtttacagctctcatgttgttctctttacattcaggttatatagaggcctgtgatagtcctcatatgatggtaaggtttctcacagcaaagaccaagctttgttaattttgtcagcatatggtgcctaacactaagctgtatacctaaccagttaataactgctgctttgttgagaatgaaaaagtttaggccccaatttcaaatattttctaccccaactatgttatgcaatatattaatactaaatatgccagtctattttcttgcttagtaataaaaatacaacgtgttgagataaaatatttctggtagctaatcaatattccagttctcaattatccatgctagattatattatgcattaatttgattgcatgctctgcagtatattgtgtatgtgttgtgcaaaggcataattgctcatgttcatacataataagtaggtttgggaatttgtctggaggtatatcttagttattaatagtgattgtcaagtgcacatttcaagtttagaacctcgttggccttctgggagtcagagtctcaatttcaaggaaaatttaaacctttcctttcatgtattcctgttcacttaatcctgtcaaaatagaagattttgtgtctaagaagaaagagctagaggctaattaaaggagtgaaggccagggtttcatggacctctgatttctctccaaatgagtgatgaattaaatgtaaataagtcagaaacataccttaggttttgcttttttttttaattgttataaaaaattaatgtaaaatttagcatcttaaccattcttaagtgtacagttcagtagtatgaagcatatttgcattgttataaaatagatcttcagaagttttttcatcttgcagaactaaaactccatacacattaaacaactccccattcccctgtcccctcatttctctcttggtaactaccattctcctttctgtttttatgaaattgactactttagatgctgcactactgcatggaaccatgcagtactggtttttttggtgactggcttatttcattttatataatgttcttaaggatcattcatgttgtagcatgtgacttgatttccctcctatttcccatataatattccattttacatatataccacattttgtttaaccattcatctgtctataaacatgtgggttgcttccacttcttgactattgtgaatttcttttttaactaagtgtatttgaaaatatacagtttctgtatcagttccattttaaattttctctctatgaagatgaaggaagaatatttttatacacttgaaaacttaaaactctttgtcacttaagccttctgtattagtacattctcatactgctataaagaaatacctgaggcccaggcatggtggcttatgcctgtaatcccagcactttgggatgctgaagcaggtggatcacctgaggtcaggggtttgagaccagcctgtccaacttggtgaaatcccatctctactaaatatacaaaaattagcctggcatggggcacacgactgtaatcccagctactcgggaggctgaagcaggagaatcacttgaacccaggaggtgaaggttgcagtgcgctgagatcacgccactgcactccagcctgggcaacagagtgagactctgtatcaaaaaaaaaaaaaaaagagagaaagaaagatacctgagactgggtaatttataaagaaaagaggtttaattggctctgggttccataggctgtacaggaagcatgacactggcatctgctctgcttctgagaaggccccaggaactttacaataataatggaagacaaaaagggggatccagcacttcacatggccagagcaggaagaagagaggcggaagtgctacacatgtttaaacaaccggatctcttgacaactcactcattatcaccaagacaataccaagggggatggtgttaaactattcaggagaaactgctcccatggtgcaattacctcccaccagaccccatctgcaatatgagggattacagttcgatgtgagatttggtagggacgtagatccaaaccatatcattccacccctggcctcccaaatctcatgtccttttcacattgaaaaatacaaccatcctgtctcaacagtcccccaaagtcttaactcatttcagcattaactcaacagtccgaagtccaaagtctcatctgagacaaggctcatactttctgcctatgagcctgtgaaatcaaaaacaagttacttacttccaagatacaatggggttatagacattgggtaaatactcccattacaaaagggataaattggccaaaacaaagggctacaggccccaggcaagtcctaaacccaacagggcagtcattacattttaaagcttcaaagtaatctcctttgactccatgtctcacatctgggacacactgatgcaaggggtgggcccccaaggccttgggcagctctgtccatgtggctttgcagggttcagcccccatggctgctctcttgggccagtgctgagtgcctgcagcttttccaggtgcagggtgcaagctgtcagtagatctaccattctggggtctggaggacagtggctgtcttctcacagctcctctaggcagtgccccagcagggactctgaacatgggctccaactccacatctctcctccacattgccctggtaaaggttctccatgagggatctgctcctgcaacaggcttcttcctagacatccaggcttttcttttctaccacatggacaggctgcaaattttctaaacttttatgctgtgcttcccttttaaatataagttccagttttaggtaatttctttgctcacacatttgagcataggttgttattaacagctgggccacatatcgtacactttgctgtttagaaatttctcccactagatactgtaaatcatcactctcatgttcaaagttccacagatccctggagcaggggcacaatgcagccaggttctttgctaaggcattgcaaaaatgacatttactccagttcccaataagttcctcatttccatctgagaccttcttggcctggacttcattgttcacatcactatcagcacttttgttgaaaccattcaacaagtctatcggaagttccaaacattccctcatcttcctttcttcttctgagccctccaactgttccaatctctatccattacccagctctaaagttgtttcatattcaggtatctttatagcaatgccccattctgtattcattttatgtattagtcagttcttgtgctactataaagtaatacccgagactgggtaatttataaagaaaataggtttaattgatccacagttctacaggctatgcaggaagcatgatgctggcatctcctctgcttctggggaggcctcaggaaccttacaatcatggcggaaagcaaaaagggggagttggcacttcacatggctgaagcaggaagaagagagagaggagagaggtgctacacacttttaaacaaccagatctccttagaactcactcattttcaagaaaataccaagggggatggcattaaactattcatgataatcttccctcatgattcagtcacctcccaccagccccacctcccacattagggattacaattcaacatgagatttattggaaatacagacccaaagcaccttagcttcttattgtagattgttattctctgataaaaactggtaccaaatatttttagacagaataatattatgaaagtcagtacaaggaacgtataaaactctgaaaacagatattagatttgtttggcagattggtgaataggcaatggaagtgaatgactctttatctcctgaaggaccaaggaggctttgaagagaattactaagacacactcataccttttaaaaagtaactcttggtcaggcgcggtggctcatgcctataatcccagcactttgggaggctgaggtgggtggatcacctgaagtcaggagtttgagactagcctggccaacatggcaaaaaccccatctctactttaaaaaatacaaaagttagcagggtgtggtggcaggtgcctgtaatcccagctactcgagaggctgaggtagaagagtcacttgaacccaggaggtggaggttgcagtgagccgagatggtggcactgcactccagcctgggtgacagagcgagactccacctaaataaaataaaataaataaaataaaaaataattcttcaaaattcaatattttccaaacttattagaatctacaaggaactcaacaagaaaaaaaaacctcattaaaaagcaggcaaaagacatgaaaagacatttctcaaaagaagacatacaagtggccaagaaacatatgaaaaaatgctcaatatcactaattatgagagaaatgtaaactaaaaccacaatgaaatatcatttcataccagtcagaatgactgttaaaaagtcggaaaatgacaaatgttggaagatgtagataaaaagatatgcttatacactattggtgggaatgcaacttagttcaggcactatggaaagcaatttggagacttctcaaagaactaaaaatagcactaccatttgacccagcaatcccactattgggtatacagccaaaagaaaagaaattatatttaaaaaacacctgcattcatatatttatcacagcaccattcacaatagcaaagtcatgaaaacaacctaagtgttcatcaatagtggattggataaagaaaatgtggtacatatataccatggaatactacgcagccatagacaaaaaatgaaaccatgtactttgcagtaacatggatggagctggaggccattatcctaagtgaaatagttcagaaactgaaaatcaaatactgtgtattcttccttataagtgggagctaaacagtgggtacccatggacatatagaaggaaataatagacactggggactccaaaaggtggaaagtggttgggtgtgagggttgaaaaactacctcttgggtacagtgttcactatttgagtgatgggtacacaagaaacccaaactccaacattatgcaatatatccatgtaacaaacctgcacgtttacttcctgaatctaaaataaaataacatttcaaatttaacttcttttccacctttattaaaggtaaagctattacttttgttttaacactatagtgaatagaattttctgtgttgttttaaataattccgtgatctaagtatctgatgcagagatctttaccaatgaacatcaatggtttttccacaaaattaagatcttttctaagatgaatttacaagggctttgagtgtgtatgtaaaaataagtcctagaattcttttacaataatgacaagcatggcctttcaatttttcaacattctgaaaattgataaacaaagtcatttaccctgtctctaattttctgaagattagattcattagtttaactcatggttatagtttttgtgtcaaccgtattgatgtatacatcaataaacacaatctttcactttcactcactcttctgtctcctccatctccttccagttcctacattattcagaatccttggcaattcatatgtgttaggtgtgaagatatggaattgtcagcatcaggaaaagctattaccttgctacttcagactgagtctttctcttttctttgtttactttagatgatttcttttttttaaagactgagttcttgaattcttattctctgacttgcttcataatccatttcagaatttcttgctcctacactttgtttctttatgaatcagtctgtgcatgagatattccatttttaacccagcttaaatttctccaatgtacccttgttttgctttcaagacagttagcaactctgaattcaagcctatgatcttcttttagaaacctgatctgacagactcctgcaaaattctaccttttttcctggctcttaatttagctttgaaaatgaagtacatactatttatctggttatacattttaaagtagattctaagtgcaaaaaatgtgcctagtcaattcaagttgactcctgattttttgaaaaaacattaagaattgaataacaagaataagaataaatataaggctactgactgaaatgtgatctttctcttattttgaacatcttatttcacaaagttctaagtccttttctatttggcttgaccgcttccatatgatcatggatataaaacgattaaacagaaagttcacattcagcaaatatcaaggtgttcttaatatcgtaacttgaaatcaatgaagaagtcacattttctgctttgtaaaaactgcctcacatgtccctggtctggcaaaaaaatacacacacaagtactgaaaacagaagatgatagcaccagctaaatagcaccattgctaggcataagatttgaaagccagcactttgcagggaaaatttgagtaaacaacctctgtggaaatacagttaattaaatctcgattctataaactgtgaaccaaagtttatataaaagagagactaagaagtctttgttgtaagtattaaaaattctgacataaggaagtgaccactctagccatatcagtgtcagaaaatgacagtgtggggctccaaggctgagaatcagtggggctgcaaaatctggacaaagaaaggcagaacaagacatagactacagaaaagagaacattatctgagcaataccaggctaatcccttggtgtgaagaaaataggagttaataccaaaaacatatggctcattattcatgtaattatgcttgcaagctatatagtaaactatatgtgaaattttcataccatagtataaattcagtcattagtttttccttttcatatatacattaagtaaatatgtattgaggaccctcagatgtctcaggcatggacctataatggtgaaggattcagctttgccctcaaggatcttacaggaatggggcagatggcaaggaaagaaacaataccgtgtggtaagcacagggcactaggggaacaggaagtagtgatctatttatctggatccttgtgggcagaggaaataaacataactaagaacaatgaatgataagtttacaggagggtaggggagaagattccaagtagaagcattgtactaaattttgagtggggcaaaagttcagtgaaacttttatttttattataaacccaccaaagtaaaagttctcagcttacatattatagatagctctctgaactggatgaatgtcagctgtgatttcaatcaagcaatgatgatatggccagatggagtgtgccacctcccttcagcattttgtcttaagagggtttctaatatggcttgtcagacagtatgtgtattccgtgtgttgctggaaatttgaagctaccgtctagaaacaaaggtcttggtctcagcagcattcagtgagttggtgccccccagtaccttggataaaaaaatgtatcctataaagggctccatgaagcacaaatgtaaaaacatgctacaaaagcatctcttcttttcattgtgccacaggggctatcactgtgagtctgacttgcaaagtgcacagcaaagcgaacctgtggtctcactactttgctttatactattgcccactccagcacctgcataaggctgaaggatatccaccaagagaatgctcatcactttgccaactgccctctgtgctctagcccagggtgggcattttttttttctgtgaagaccagctggcaaatattctaggtttcatgtaccttacagtctctgtgacagctaatcaactctgccgtcgtagagaaaaccagcacaaaaccatctataggcaatagacaaatgaatgaatgtggctgtgtttcaatcaaactaaatttgcagaaacatgcagtggtcccaggccatagtttgctgatccctgctctcaacaatcctttaaggtgtggtatctggatcctagcatatgctgtttctgtttcatgaaacattcctccttcatctctctgcctagctagattttagtaattcttcagctattagcagaggttattttttgagggcagatgcctcactgatgccccaaatctgatggtatgccacttcctctccagagtactgactgatttctggttgtctggagacttgctctctgcacttcagagtatgagcttcctaagggtagaaatctgcttccctttctgcctgctgaatccctggcacctaacacacaatgcctgggacatagaagtgactaaatacatatttgtttaatgcttaacaaatgaaattacttacatcttccttactttgttaggatcataattctagcaggtgaaattatttatggtcttatagtttatgagccatgtcaccatgttatcacattgtaacaaagcaaaggtttaactatatctcggctccagtggcattcagagggctgtggaaatcaatagttttagcttcatttagctaagtggagaatgccatttgggcagtctgtgtctactaacaacttggtccacacccactgctctgctgtctcgaggtggagaataacacctctctgtccccatcagtgtcttccactctttttagaagtactgccagcacaatgctgtctatgctccaatgcttaacaaaatttttagtgaaatgttgcttacctttttgatatatcttattatcatcctagagcccagagaagtgcattagattaacatggaatcagaatccgatgtaaccagaataacttccctccaccaagactaatgctttgttactgggtctaaaatgttgggctcagttcttgggaagacttacttcccaggaagctcctctgtgtctcttaggctcacacttcaaggaggctgctcattaatttttcaacatgctcaggtatcactgtgaatcctggccagagcaagctggtaccttgactactcttttttcctcttccacttgcaggtagaacaacaactaataacaaatgtatatatgtagctcactatgtgccaggtattcaccatctgtaagtgatttaccagtagtaacttaattgaaccttgtggtgattctattgcattatctttatttcaccaaggaagaagctgaggcacagagatgttagttacattgcctaaagtcacacagctagtaatgatggagctaggaatataactcagacactctggttctgagtaaatgccctaaacccatgctgctggtgctgtgatagctgagtctcagcctcttcctttctcctacccctaaagaatatacagtcttcattctacccacttctctctcagaatctcagaaactaggaaaaaaggaggggtagaaaacacataacagtgcataacttatggtacagactgagacttgaggggaaatattcagagaccactttagatattaggcaatgctagctctataataagtagaaaattccaaattcaagatattctgagccttgaaaatcatgagggaaataaaaatgcccttgaatggctatgctgctttctctattcaaagagctagcttggaacactaaaaggatgttcttattcactaagtgtttttcactgtttgagtctgcagtggagttttagccacaaataaatgtttttcctaaaattgaaatcaatttgtaaaataatgtagaaaatataaagcctcttgctgtttttctcagtgataaagcagcaggaccgcagcaggaaccaaccatgaaaaatgtggccacctcgttgagctttgcactaggaagctacttcattttcacatacaaggattctccctattccgtgttgcaaataaaaattagtaaattagtagtactaagtttaatgaactctactgaactctgtgtgatacaggaactgacaactatgggtctgaagatattacatccctgttgctttgtgaaaattatctttactccagacttgatagaattagcgtaaacagataactcatccatctttcaatttaaagaccttccttttcctcccatctttttccttttcatcttcaatggttaattctcatttgaaaggatcattcccttcatagacatatccccggactaaaacatgctctttctaacctaaagaaatggtttcttcataaactcataggcattaacatatttttgtaaggtcaccaagagtgacttgttcggggtacctgaaagtcaatatggcgataaactgaagaatcagatttttcttcctgatttttctaagattattgtgggtaagatgaaccatcactttttgggccctagaaactgatttatatagagactagaaaatgttttacatagagaaactaatttatatgcagattagaaaatgtttttggagtttattttcccactagtaaagccaatttttttctatgtaatgaatccattcacctacccatctacccatcagtctacccattcacatgtccatccatccatccattcatccatccatccatccacccacccagtccaatctataattctaaccatcttgaccctttttatattgcttctctgcttcatttttatctttgcccttgtcatcttttactatttgacacaagttttttatttcatttattgtctgcctcacactttagaatgtaaattccattaagtcagaaattccagtccattttgttcatggtgtatccccagcacctagaacaatacttgacaataaatgataataaatgtgagaaatgttgcaagaatttttattaaatatttatttagcatttactacttttaaagcactggattgagtgccaaaaaggatctaagatgaagcagatatgggtctcactgtcaaggaattccaggccaagaaagctatcaccaaaatatattattttaatggcatcattatatagggggcaaagttgttttcatgagaaaaatgaagcatatgtggtatttatactgtgcctgagtgaaaggcttccccaaggaagtgacacatgacattgaataaggggaagtatttgaaaaccgagagttgtagtggaagggcatcctagaaaaaagtgacaactggaattaacaagtggaagtggaaaatgcaggatatgttggagacagaaaagcaattggttcagtttagaggaagcctagaggccagaaagataataatggagaagatctatttggaaagagtggttgggtcagattatggaggattttgatgtcacctgttggcagtagcgagtccgagattctctcgtatctgaacctctctgtctcccctatattataacttttgaatgacaatattttatgcttcctgttctggtttccaaagcagcaatgtggccatcccagtttgctagagcctggaaggattcttgtatgaaatgcaaattcagtctttgatctacattttgtaggtcaacaacctcagtttcgtggtggtaattacagggctcacaaggatgttgttcttgagtaatgaatctaatatattagtcacaaacagtaagcatctcacttcccctactcctccttttggttaaggagcacaaattgtccccagttctttgagatttcttccgggttcatctggagcatggatttctacctttgcaaacatttaacttgcagccctagagctgtgtaataacagatagtattttctactcctagccttatctggggagaacacacacaaaaaagtgttttttattttggcatgtgagactatcgagtgtgtccttgttccataagtgtactttggcaccaggaagcagagacagcagctttcaagtgatgggagaaacagactgattaagagctctgcctgggcagacggtactgaaactgggtgtgtagtccttgcctcatcatttcagtttttttaatgtaaatttttatttttgattgaaaaataataatgtatgtatttatggggtacaatgtaatgttttattatacacagacatgcacacacacgcgcacacacacacattgtattgcagtattattcacaatcgccaaaacagtttgggggttttcatgaaaaaaattccaattttgggtctgttagtatattttatcatttcccccattctcaattctttttcctctaaattcctttccctctcagttaatgacaccactgtcctatctttccatatacccagaattaaaacttcagtgtcaatgggaaaaactggtcataacatcatctattttaattaaatttaagtaatttatttacttaaaaaatcaagatgaaaatacctaatttaaattaccactgaaggctagcattcatttccatggcatggccatttatttgttctttgacttcatcttctcctattattttcactcctatccattgaataaattctgaaatgggaatagtatcaaatgggagtgttacttccacactttgctgggtggagcaaacctatctcctcacaaaagggatagaagtcagtttgcagtgacttccctgatcctaccagccagacatgctccttgcctctcttcttgcctcctcctttaatatttaaaatattttttttaattttatttatttatttactttttgtagagatagggtcttgctatgttggccaggctggtctctaagtcctgggctcaagtgatcctcctgcttcaacctcccaaagtgctgggattataggcgtgagccacggtgcctggcttctgcctttttgtgataacagatggtaacaggaatgacaccacacttatttgtaccactgtcatggctctaatgattatggctttgaagtagcatcatttgtttaaagagctcaggttggtggcccagcaaactcgggttcaaattatgcctctagtgctgacttaatgacatggggcatgtcgcttgaccttgctgggcctgttttctcatctgtaagatggagattacaaaaactttcaaggtccttgtgggaagtaaacaagttaatatatgtaaggcacatgcacatagcctgggacctggtaaataggtgccaagggtagttattactgtggttgttattgttagagtttttgttttacttgtgctaaaaatagaagattcccaaggacagaagcttcgtcttctacaccttgaagggtagtgtttttaataagcaaaggtgagtgtgtgaggtgtcaggtatgagcactgagctgtggaggctttcttgatcttttgctttgtattttaatagatttcttcttccagtatcctgcctcctggtaatgagaaaggggataaggtaacttacacataaatttggttcaggtacatcattttttgtccctagatcatagatatctatttgcaaggatgcaatctgtgatagctaaatgtttgctttgttttataaaatcaagctaagagaaataaatgttaggtttcacataaaaaaagtccttttcagaaagagggtgctgtaagtatttccattctctcaaagcattctagagacagaaaaagtgttttctaaccccttcccacccccaccattcttttcttttggtgcctggtgaagagtacattaaaataggaaggaacattccagagtgctcaattgcctctgttcagggtccacagctgaatttctaagttctttctcctgtggtttatgcagcctatactttgactacttctagttagacagaaggaaagctcacacattttgcagtgagccaaggtaaaagagaactcttttgtcaaagtaataataacacttagcacttatatagggctttttatcttcaaaaggccttgcaaacattagctaattaagaagtctgctcaatgtgcagcagctgttgaaaaaataaatgtgatgcttgggtgtattaaaaagaagaacgaaaacatgaggacatcctatatcaagcagctgttgtactccgtctaatttgtttgcttcacctggtggaatacatcagacgctaaaatagtcctgccccatagagtaataatggttagggatgaggcagagcttgtacataatggaatattgcaagggctactggatatttaccggaagaggaaaaaccaaagaaaagctgcatcgcctaatttttattacacttttataatcatgggctcatgcagcactaatgaaacagacatctgacatgtctaatgacatgaacatatcgtagattctttaagaagaacctatttgcaagagcaagcattctcatttattcattcaaatttactaccaaatatgtattgagtacttaccagacactggagacatgcatttataaattacttggggacagttttgaaacagctgtggctctatcatcttacatgttatttacctattgtaccttaattttacattaatattgacacacatccacccagacccatattaaattcaatcaacatttttattcgttgattctttggcagaaatgagctaatacaccattgcaagagctgagctattattttggtgatgaaaacaaaatttagaaataaccaaaaaatgttttttttgtggttttctgcaatgggcatttggatatggtcctcttttctttttcttggtttttataacaacagtcattgagctatacctgctgttctgttttaaatacctgtttcaagaggttgcaaattccaaaaacttgcaaatttcaagaggttccaaattccaaaggaggtggtacatgaagagaaaagggacagagatcatataatgtcaaaatgtaagtgcctgcatcccattagagtataccccatgttatttatcaaagtttacacacatgcaaggcgtattagaataccttacttccattgtacagaaggagatgggggaattatactttggattgagttgattgttaaaatggggttgtaagaaaaattatttcctcattcaaggaggacaaattataaaagagatagcaaggaagtgaataaagaagagaaggtgttctaggtattgggaaaaaattgaaacagaaaatgttcctagacaggagaaaaatgtctgaaggaattagaaataggtttatttttgctaaggaaaagttacaagccaccaaataaagtaaagtagcaaggagaagccaagtcatgcaaagccaaggccatagttacaaagataaaaaagcatctacttgtcatttcccaagttcagaggatggaacagcgtgaagtgactagaagcccaggaccaacggttgattttcaaaggtaaatggttggggaggggttgactcggttagaaaaaaagtcaatttcagtgatcacaggctcatcctggagcattgcttacagtaggaaatatttggaaataaatcaaatgtctattttttgttcgatcatatttttctgagaagaaaggattgattaaataaatcaggatttattcataaaatggaatactatgcagctattaaaacaaggaagctctgtcactactcaaagctcaaatataagttgataaagcaaggtaggggaaagtgtgcatagtgttaaaacttgtgtgaaaaatatagatccaaatgtgtgagtgcattcatgcatatttatatatgaagagactatagactaactctggaaggacatgtatgaaaatactacagtggttacccctagtgaagggaatggagaaattggaagactaggtagatgctagactcttactttttagtgtatatttcctccttctcccctaaacctttttttttttaaaaaaagaaaacattttattatgagataattatagattcacatgcagttgtaagaaataatacaaagagatcccatatatctttcatccagttttctccaatgataacatcttatgtgaggagtttaatgtcacaattagaaagttgacattaatataatccactgaccttattcatatttcaccaattttacatgcctttgtgtatttgcatgtgtgtgcatgtttaatgctatataattttatcacatgtgtaagttagtgtaaccaataccacagtcaagatacagaacagttctatcacaaggatatctcatgctacccctttatggccacagacagctccctccttctctcccctccttactcctggcaaccactaatctgttctccaaagccataattttgccattttaagaacgttgtataaatggaatcatgtagtatgtaaccttttgagataggatttttatattcagcataattcccttgagagttatccaagttgttgggtgtatcaattcttatgaagggcatgttgttggattgttgtttttatccactctgcactccacaaatctgatttttaattagtgtatttagaccatttatatgtgaagtaattattgatatgctagggcttaaatttgccatttaattgtttgttttctgttcgtttccaccatttctcatgtttctgtttgtcttttcttatcttcctccgggttacttgaacattttttggatttcatgtttatatatttacagtgattttgagtctatcattttgaatagttctcttagtggttactctaggtattataatatacatatataaagtagtaatatctatgtgaattatattccttttttaccttttgggctactttgtcttacctacaagttaaatttaaaaataaataaaactagcaaaccaaaacactcctacatgtatacctacttaaaacaaataaaactcacctctgtacagaaagattgtagacaagaaaagaagtgaaaaccaaagcacttcagaagtcatgcaaagaaatcttgaataagaagaaaggattaaaccaaaacttttagggcatgactgagaaattgaaaactgggggctgtccaggacattagaagcctggagcagagaaagccatgttattgagtatgtaagtttgttctcacattgctgtaaagaactacctgagactgggtaatttatgaagaaagaaggtttaattgactaatggttccacaggctctacaggaagcatggttgggagacctcaggaaacttacaactgtggtgggagggcaaaggggaagcaagcacatcttcacagggcagagagagagagagagaaggggaaagtgctacatacttccaaataaccaaatcttgtgagaactgtaccatgagaacagcaagggggaagtttgcctccaatagttaaatcagctcccaccaggtcccccctccaaccctgggaattataattcaaaatgagatttgagtggggacacagagccaaactatatcattgagtatccaggccttgtttttttatgacctactgcttaccacctggtagacctcatttcatttcttaaactctttaggtttcaaatataaaaggaagttaataatggaacctacctcgtagaattgttgtgaagattctcaacatgtatgtaaagttcttagtgtcatgtctgacacatagacaaactcaagtaattgcaatcatataactgaaccttttcttgagtgtctactggggtcgcaggggttgcaggttacaatgatatggtgccattcctcagaatgagaagatagtgccccagacatgtttatagaccctttgatacttccctcgttggatgaaaccctcttttcagtttctttccactaaggatagatttcagcatatcactatgcttgaagtaaaaagagcttactccaggcctcttggctcttgtccctaccttagactgatggccttggtatttggtatgtgaagtagcagtttggatatggagtacaaagagtgaaaaaaaggttggatatggatttttagactcttactttgggaggatgagaaaaagttctcagaattgataacattgtccctagtagtaagaaatatcatttttcctgtctttctaggcatccttgttgatagatctttggatagaattttttgcagagaatggatgatgtttactttttttatatgtaaatgattctaaaagttgcttttttaaggctgagcacggtagctcacgcctggaatcccagcactttgggaggccaaggtgggcagatcacctgaggccaggagtttgagaccagcctgaccaatatgaggaaatgccgtctctaataaatatacaaaaattagctgagcatggtggcatgcgcctgtaatcccagctactcaggaggctgagacaggagaattgcttgaacccaggaggcagaggttgcagtgagtggagatcacaccactgcactccagcctgggcaagaagaacgaaattccttcccccccccaaaaaaaaaaattaaaaatttgctttttttagtgtttttgtacaaaggatcatcgtggtatgatggcgcttcacacatgcagaatggtcatcttaggctattgtaaccatgtagagagcaattccttagggtggtgtttttttgttgttttttatttccttcattcccaacttttatggtgtagagctctggctccatttcaaatcagcggaaaaattatcatcagacctaagaatgttttcttttgagatggcgtctcactctgtcgcccaggctggagtgcagtggcgcgatcttggctcactgcaacctctgccgcccgagcggcaagtgattctcctgcctcagcctcccaagtagctgggactacaggtgcctgccaccacggccggctaattttttgtatttttgtaaagatggggcttcactgtgttagccaggatggtctccatctcctgacctcgtgatccacctgcctcggcctcccaaagtgctgggattacaggcgtgagccaccgggctcggccaagaatgttttatatttcctagtttctcttccttttgtgggtcctaatcttttgtttaacaattgatttctacttcattttgactatatattttcttttcaagcctttttctccctgcatcttgccaatatccctaaccccattcactctcggcaaactcgcctaaatctcccaccatgaattttagtcccaggttagacttttaacctcatctcccattgaacaaactgcaaaaaatattaatacaaagggcagtttagagtcaacaaaaattgagaacatttgcagctgatggtaccatctgtgcctgtcaaactctggccaagtagttttccatggtggagaaagagagaatctcatgacggcttttggtttggggttattgagaactgagcctgcactggaggaagactagaagagctgggaggcagctctttctctttgtggtgtgtggctcatctcccagaaaaacaggcctctcccagaaagtggtcaaatttggcatctgagacctgagagtggcctcctgtgggtcctttctctcctagcccatctgcgaaaatcaatctgtgccaggtgctccacatggcagaggggagtggtggagtcatgaaaaagaattaagcaaacaaacaaacaagcctcacagagcacacaagaaatttctgaagagaagtttcccaggcttttgatgaggcgaaacaggaggaccatagagcagcagaggaagaggaagggggaggatatggaggttacctgatggcctaattggttccgacaatgcactcctttgttgcagagaatctgaatcatggaagaagcaaataaataaagaaaaacatatggcagctaagtcatatcaatctacattaagaaaaataaatgagaggatattagggagaagatcctgagaggagaaaggcagatggggactcttagaaagtattcttaaaatgggcaggaaatgtgaaaagggactttaaaaagaggattgtgggatgagcaatgaataagtaaaagggtacttaacctcatcactcatcagggtagtgcaaattaaaaccacaatgagataaaaatactaccagaataactaaacaaaaaatgatggatcaaaccaagtgttggccaggatatgcaggaattgaactgtatgacagtgccggtgtgagtgtaattagtgcaacccctgtggtaaactatttattgctattgttagaattgaacatatgcatatcctacatcatggcaatgctatttctaggtgtatacccaggcacaatgagaacatatgaccactgagcatcatgtacataaatgtttatagcagctttattcacaatagccatatttgaaaataataaaaatgtccaccaacagtagaatagataaatatattgtatatgtcatggaacactatgtagcctgaaatgaatgaaatgagaaagaatgaaatgtggatgcgtctcacaaagataataacagaaaaaaatcagatgacctggatgacaaagaagcatagtgtttggagtgttacatgtatttagcacattatggagaaaatagagtgataacttgagttctagtgagctccaaagggatggaatgatatgtaaaaatcaccagaaatttgtttaagccatactgaacctttctataatgagacctaaatagaataaggtactgggtaatgaatgtttcccaaattatggcatgaatgtttaaggactatttcattttaagagatgcagtgtccagaaattgtcaccatggtagtagtttttaaaatgtgttcctcagagctgattggctctaggagtgtgtaactcaggagtgtcatctaccatctgtttatctatctagttaactatctattgtagagaaggttgtggtggagtaaaccaaacaggcagcttgggattcatttgttggggatctgcacaagatattgttagaaaatagtttgggctgctaaaaaaaaaaaaaaaaaagaaaaaaaaaaagaccacttctttagagaactgttagtgtgatgataagagattatagggcaccaggaaaatctagcaaatacagccatctaaccaaaaggcagtattaccatccttgctttgccaggggcaagtgttgatatagacaacatttggaatttggagtctggagtgaggactcctcggaatatgacacttaaagaagcccctgataaaatctagctaataggtagcaataataatattagtaaacatttattgaatatttactattatttagtgatgtctgctatttttatacatcatttaatcttcacaagagcacagaccttgtagtcatgaagtagctgctctcaggctcaccctcccaccaagaagctgaataaattactgtttgtaggaatcagagtacaccaaaatgggctagcatttgaaagatcaagaattctcaaagaaggaaatgcattgaggtgaatgggacctctgtgggttgtttcctgtgatgcatatgcaatacttagaagaggcatagtagcctagatcttacaggaattgcagtgggactggtagatgaaaattcatgttcagggataataagacagccacaatatgagggaccaagattctggagagaaggaaccacagagatctgagccagaattctgcacgtgactttccctgaggaatttgcagatttctacaccacactagcagtgagatactgagaagccaagaagaatgcagtagtttaaaaggccaaaaatctaagcagaaatgtaagcaatcccagagaactgaagagacagaaattgtagttcagagcctcccaagcaagaaggatctttataaacatggcagattctcaattgagaatctgaagagctagattctaatagtatgggcaaactgaacatagaccattctctagtggatcaagataacctgtgtatgttctgtcttccagaaaaaagtggaatcctctatgtaggatttcagggtctaaataattattttacttaccatgtatgataggcaatagaacattaccaggcatgtcaggaaatataaccaaataaatgaatttcttagtgaaaacaaataaactgtaggttattgatatattgggattatcagacagatttcaatacaactatgattaatatgtgtaagaaaatagatatcagattgattatttcacaactggaatctgtagacaagaatacaggggaaattctagaagtgaaaaacttaagaatctaagagatatgtttaatagcagattatgcatagtagaagagttgattagtaaagctgaaaatgtttataaaaataacggatcaaagcatcaagattaaaaaggtgaaagataaagaaaagagcatagcagacacccagtgaaaaatggtgcttctcaaagtatggtcctgagaccacttctggtgctggtccctgacaacatagagtgttcataaatgtttatagcaattgattttgccacaacattttaatagcatattttatgacaaaattagactctaagggattataaataaaaaggaaaaatattaatcacgactagtttcagaaacattggtataacataagtatgttggagtcccagaaatggggaagagaaagaataaggcagaagtaacatttgaatctctattggctaagaatctttcaaaactgataaagcctcaacacacaacttcaaaaggcttcatggaccctaagcagcataactacaaataaaaacttacctaggtacgttagaacgaaactgctgaaaacctaagaagaagaaaagaaaatcttaaagtctgtcagaaaacaaaacaaaaaaaaccaatcttcaaaggaactgtagttcctgaagctgctgccttttcaatggaaatggtctagaatccagaagtcgatgaagtggcatcttcaaagtactgaaaggaagtaaccaccaacttaattctatatcaagtgaaaatatctttcaaaataaaaataaaatatttgtggataaacaaaagcaggtaatttgtaaacagcaaacccacattaaaatattatttatctatttatttattttttttaaagttgtagagacagagtcttgctctgtcacccagtctagagtgcagtggtatgaccaaagctcactgcagccttgaattcctggactcaggcgatccttctacttcagactcctaagtagctaggattactgttgcatgccactatgcctggctaattaattttttttttttttttgtagaggcagggtctctctatattgcccaggctggtcttgacaggctcaaacaatcctctgacctcagcctcccaaagtgctgagatttaccggcattagtcactgcaattggcccccacactaaaatattgaaagaagctgctcaggcaaaagaacatgatcccagatggaagtacagaaatgaaagaagcaatgaagagtaagagaaaggtttaatataaaggagcatatagataaatgttgtgcaaaacaagtaataatgtctagtaagattaaaatactatgcattaatagccaaaaatgcaggagcagggtaaactattaaaatgttgtaaggctcttgcaatgtttcagaacttatgaaggcatacattatattatattctagtaagccaagaattaataatgcaattttaggatgattactaaaaagaataacaaaagaatttagatgtaacaaactaagagataataaatgggaaattttcttaagtacttgataaattttttaaaagccaggagaaaaatataggaccaaagaacaaatgaaatagagaacaactgtgaatgtgttagatttaaattcaaatatgtctgtatttacattaaatataaatggcctaaacattctcattaaatgacatattgcttaactatgtaaaaaataattttaggctacataaagagacatactcttaaatatcaggcacagaaaggttaaaaataaaataatggaaaaagatatactgtgcaaacaccaatgataaagaagctaatacagctgtactgatattaggcattatagattttaaggaaggaaatcatgttaaaaataaaagatgccatgacatagtgacaaaatgggcaatttgacaggaatatttaatgatccgaaaagatatgcatttagtagcacaaaatatttaaagcaaaaactaacgaaactaagaagagaagtagataatctgacaatcatagttggtggttttaatacccttttccttctttaactatcagcattagccaacaaaactatgagtgaagatttagtagatttgaataacacaattaacaaacttgatctaaatgacatatagaactctacatctaaaagctacagaatgcatttttttcaagtaaacataacacctttaaccaaattaatcacatactggtcaataatgcaagtctttaaaaaattcaatgagttgaaatcacacagaatatttcctctgatcagagtggaaataagccataaattaataacaaaaagataatgagaacatacacttaatgctgtgacccagtaattccattcctagatacctcacattcatgggtacatttggcatgaaaggaagtatacaatcatgttcatgcaaatcaaaaataaccctgtgctcattaacagtggaatgaaaaaattatatgtcaaaatgatacatcatatattcatataatgaaatagtgaatgagctagtggtatgcacagcatgcatgaatcttgcagatacaatggtaagcaaacaaagccagatgcagagaatgcataccataatatttcatttatataagccaaaacaggtaaaattaagcgatagtgatacaagttggaatagtgttctgttttccttgtggacttgttatacttcattaacacatgtttaaaaaaaacccaaaaatatcgcaagataaaaaatgcagaagcattttctgggtaaagaaagatgggcaaacattacaaacagaaggaaatttggggggttcaaattctgtatcagtcatgagacttctttcctccaaaaaacttacttttgaacttttaaactctattaacattcttatctattatttattatggaactagatataaccacttatagtaattgtctcaaatctgatttctttccatctatattacatgtagggtagtacgatgtagtggttaaggacacaactctagagagagactgaggttaaatcccagttcaaacatttgggcaagtcacttaaactctctgcatctcagtttcttcactgtaatgtagaggtaatagcaatatctatgtcagagtgctgttttgagaattaaaagaatcaatataattagttacaacagtatctggcacaaaagtaagcactccgtaaatatgtgtgattgctactataattaccttggaggatcggatcattccttatatttgttttaaatccctcgaatacctagaactatacaagcaatcaggaagacgggctttctggacagcgagaagggaagatattttggaaactgactctgttttctctctgtgggtgaggatgagcttacattgatgacaagtttggcttatgaactaggaccttaagtagagctgcataaattagtgtaagtgttattaataagatgggaagaatttgctttctcagttctggcaggaatttatgaccctgagagtcactttatgaccctgagtttgccataatcagcttagtgttctgataggaaaccaaatggtaaatgccaagacgctggggcattggtctcttgtctgcatagtcaccttactttcactaggatctttattcatgttctttatttaagttgggaacttctagcaaggttatgtgtgtgtcgtctacagatatgtaagcaacctggactctgaaagcctatatattaaaaaaaaaaagtttatggattgaattgaattgaatcatactgacttgaactggagtgaatcttgagagatggctaagaaccaggaaggcttagtggcttaacttgtaaggctatgagtttgattcactagatatgtaaattttcacaagacacttaacttttcaggcccttagcttactcctttgtaatttgtggctaataatcataggaaccccacagggttgttgtaagaactaaatgaaaaatgtgcctggtacatgtattaagcattcagtaaattatagcaattgctattattgcggttgctatttttatttctcagccaagaggctcaagccagggtgaatgaattgtgaagctgcaagcttttcaaatgtgctccttccttattttaaaatcctttttgtttttattctcctgacaaccctgagagcttggacagggtaggggctattatctacaggtggcatttgagataataacatagagagataaagtgatttgcctaatgatctcataactgtgggtgttagagttaaacctagaccccaacattccctagagccagccttgagatttttattaattcctgctctatctacctgcttatctcctgataaccagcaagagattattcttcacctctgtgtagaagatttctgaaagaggagtattatccaaattaccagcaaaagaaaatcttatcttttcagatatgatagatggctgacatagatcagtagaggtttttaagagttctaaaaagttaaacatggaagttttattttagggcctggcatcctcacttacccatactgggactcattttacccttaacctctctccagcatggtatttcatcttactgcattcttcttgctttatagtgggctttttccagttctctgcctaacttaatgaagaagattatctcaaagttcccaagattgttacttctcatttcaagctaccaggagagactcagcaataaatttttatattggggattcagtttccttgagaaatctttaagtcaataaccaaaccctttaaatttccttaacaatggtgactgtagggctgtgggaggtgttcttttaccttccctctcggcactaaatgtaagctccctgaggacagggactttgtctatcttcctgcaaaattcctcaggggacagtacagtgcctggcacatagtaagtgctccttacatatttgccaaatgaagggatgatgtcccaactccaaaatttgttatattttaattaatttcatatctttgttatcttttgctatatggatagatttttagcttagattctgtttagatgctttttggtttgattctggtttgggcagcttgagaaggctgtagaattttttcgtgttctagttagattttaaatttcctagctcctcagtagagttttctgcctctcccttggcccaagtatttaagtccccaaatttacttgcttttgaagactggattttgaatgtaaataaatgaaaaataattattttgtcttaataataataattaaattatagcactaagtaatttaggaaattttagatataggtagggtattctgttgactgaggtcataggatattcttaaaattggttttttgatctgagatacagcattctattcttgccaggtcatataaaatagaatttgctactattacttgtatttgatttcccctgataggctattcagctaggccagccttctatgactgaaaaaaaatctttaacaaacaaagctgacaaaacaaagtagtaaactagcctgctttgggtttcaaggtgagtctccggtggactctggagcagaaatcctaagtttcttctgactccttggcctgtctgatgccataagagggtgcagggggagatttgctctgcttctcttctgtgtcaaggcagactgagaagcttttaatccactatatttcaaacagttgcaagtaaaaaaaaaaatgtcatgggaatacccagatgtgggcagataataaccctactttttactcccacttattaatccataagaaggaagggggtgagaaatagtctttggacggtcagctatccatgtacagtagttggatgctgagcccttttcaaatgtactcagaataaaagtgaaaccctactacttgttttgcccattagatagcattatctccatggaacgccaattcatatctctttgtgctgtgtgtggttctcacatatgggattttaataacctccatgctgtgctatgaatttataagcagagctgatagaggaaaagcaccacaggactttattttttcattattactcttttgaaaaacagggtctgcctcatttctgtaaggttctcacagtactggcaatgttgcagccagaggtatagttgttactatggaaaggactaagctctttatttatttgctatctatttttttccagactccctttcccactgctgtcctgcctttagccacctccgtaatatccactggcattgtacttgaagcttcagtgaactgattgcaaggaaataggctccatttgttctctagctctgtggtttatcttacattctgaatgttttttctgcccatccttttaaatgtggtcacatttctcctctgtataattctgcaggtccaagtatcttatttagtgcagtggctaagacaacaggctctgtagtcaactagtcatggatgtgcatgctgacattgctctctgatccttgagaaattatttgagttttgtaaattcatctatatgatggtaatgataaaccttcctcctaaggttggtgtggttgttagttggtatggtgtggttgttagttggtatatttccttttttttttttttttgagacagagtccccctcagtaacctaggctggggtgcaatgatcttggctcactgcaacctgcattctgtaaaagggactaaaggggaggatttaccctaagcttgattgagtgttcaggaaaatacttctttgagaagctgagctctgggctaggtcctgcatgatgaaaaggtatctgcaaaatgggaggatgagcagaagacaaagaatttcaggaaaaagacagaatagtctcagtcctgaggctgagacaagaacatggcatggttgagaaatgtaaagaaattaagtgtggaggctgaccatgactgagatggccagagtccagggcacctggagccacatgaagagttttgaagtttattcaacatggaacagaagccttgttgatttgggggttaacacaagtagtgaagcagtttcctccaggtttcttctaccaaggaatgccagagagcagtgtcttgctttgtgtgattagtgttttgattcattacttttatgggttgatatgtcttgtgagaatatgagatgtggattccagagcttaaaatctgcacgtttagtttgaatgctaattaccacaaatatgtttttaattgataactgtgtttcgacatacttcattacgtttgacctttaagatcatttttaactcatcctctttaaaaaagttctctttgaagaaaatataacacacatcaatggcattttaattgtttacctttggaatatttttgtgttggacacaatttatccatcaaataaaaagtgaaaaaagtcatattttgagaaaataacacaaaatagggccaagtgccaaacatcctaatatatttgttttctgcatgatttattattacgccttttttggtaccatttactaagaatatgtatgacttaatttttcataatagccagcaatttaaggcagcaaagtatttgctttcttccactgatctagtaccgcctatcattgtatcatactgacctttaatccagctcttacacacaaagtcagttatctgtatacttatcgttttaatgggttttgatagatttccccatgctcatttagttatataaatgatttattatttatgtttgttttatgatagtttttatgggttttgttttgttttggtgaagccattttgtagtctaacaaatatttcttaattgggtatgcatgaattttggctaagttgctccatataaataaatgttttgattacttctaccattgtctacagctgttatcatctttaacctccaagttttcttaattttcaaaaggaatttattgaatttaatctgagccagtaagacgggctttgatgttaagtaatagagattagttgcccctctctgatgtctacgttactgaaaaattattaactaccaaactcctgtgacacagtatccttcaaattccaaaacttagctacagtttaccttactaaaatctctgctactggtaatcagccttttagccagtgcagcatatattcagcttttgccagaagatggtttgctcccaagggcttttggctccaaagactaagtgttacttggtggctttggcaggattcagaggagcctggctgctgggaactgacatgctcagagcttgccagccccaaaccattgtgtacctcacagctctcagtgccaggagtttgtgtgccaagaaaacagaaacctgtctagaaaataaactgttttctcttgcacatgtcctctaggaagacaagaagaggttgaacctgtaaattgttttgtggttagaaatgttttaggtttttacatgggaaatataatgctataacttcatatgtaaaacaaaatggcacattatttatgctcctcaaatcattttacctccaattattaaaatgcttatatatatatatgtatttttttttttgagatggagtctcgcactgtcgcccaggctagagtgcagtggcacgatcttggctcactgcacgctccacctcccaggatcacgccattctcctgcctcagcctcccgagtagctgggactacgggcgcccaccaccacgcaaggctaatgtttttgtatttttagtagagatggagtttcaccgtgttagccaggatggtctcgatctcatgacctcgtgatccgcccatcttggcctcccaaagtgctaggattacaggcttgagccacctcgcctggcccaaaatgcttattaatcttttaagtgatcaatatagttgttattatgatgacagtcatttcagctcttgcactgaggcagttcctgtgtgtgaaaagcttctaatgtgagtgtgtgctgtggatgtatggagatcaccccagttgggtggttgtacatgaatgaatgtgggttatgtgggcaggtaatgctggagaagtcagtggaaggtgaattaaccagctaacaaaacatttggataattgaatgttctttagaaacaaatcgtaagccattaggaaagaccttccttccttccttccttccttccttccttccttccttccttccttcctcccacttccctttcaccttccccttccccttcccttcccttccttttcttttcctatagcacataacattggaattgactctactcactttcatccaactatccctacctcttcttcctacttaccctagatttttatttctatttctctaccagttcatattttcctccatctagttttcatcagagaaaattttctgcttcatcaaacacaaaactgagatataaatgtgggagcatatgaaattagagcttgacctacatttagtacaattagtattattctaaggaagtagacagttgtggaaaaatgaaacttggaacacagaaaaggttaaattcatggcgcttatgtagcttattttcattaggcctgttacctaattacttattagaatttctttctatcttttagaccttagtttctcaaccttagcactattgacattttgagtaggataatgcttcgttgtgggtagggggctgtgctgttctttgcaggatctttagcagcttcttggcttccattcactagatgacggtagtatcccccaattgtaacaattgaaaaatgtctccagacattgccaaatgttccctaggggacaaaattgctccctggtgagagctgcttttttttagatccaggtgcttagacaaatgatgatataaatcagtacattaagtagagaaatttttttaaaaatcagtttctaaagactagatttctcaacaacttatcacattatttccaacaacattcaaattcaaaagctgatgcccaatgctagcaaagtatgaatagatagaaagtaaacatcttcctttgcattagataagatgcccagcaatggaaatccctggatttaaagaccttgttaagatgtattatgtcagatgaaaagtgctattttaataactcattgttattcttagcatggatcttttattttagaaaaatggataattagcattttggcttatcactttcccttaatgaatacaaataatttgatagacagacaaccaagagagacttcattaaataatgggattaatcagcctgggactggagtaaattagaggttagacttccagcctgagagatggaattcagggtttggtggcaatgtcatccaattcatgaaggatatttttcttgattgacctaatgttgcagtaaaaaaccagagcaagggtcaactggccaaaaataaaagtcaaaactcagcttgggaagttataggctacactgcatttaacttgcaactggataattgcaagaacacattcaaagcgtcactgcaaagcccttgttgtttagccctagctgcttcaatttctagataatggtccattattaatgtggaagtattagaaagttttccagggaaaaatatcaacctggaaccattcccctttgcatgcattatacacttcactgccatctggttatccataatatccccaaacccctaccaattttccaaaaagaactacaaataacgctttgtatttttagaacagtcttcctaacacccagagaggaaatctattgtgaagttaattttctttttcaaatgttttaaagtaaactattctttatttctaagaaacaaaacccaatgctatgtttaagcagtgatttggaactgtcttactgtcactcagagaagacaggttagtggaatctttaaggccgtggctgtcttttgaagcttatagtgtagtctttagaaagtcttcagaaaagatcatgattcttatggaaggttatttctgtggggcagtgggagaacttagatctgagaaatcattctcatcatgagttagaggaatgattttattcacaattcatactcttcattcattatccaacctacatagaagccttagttctgtgtatccttaagctgcatttgacattttacctcctgatatttttctaagtagcatttttctaccaacagactcaggtgaaaaagaaatgaaggtatcaagtatatgatgtgtacacatttagctttattactagcatcttctaagaaaaatagcaaagagctaaaacgaaaacagaatgattctataagtcctgaagggaatccttctgtgatacaatacaagcaatagaaaggccttatttctccctataaaatgtgtgtaattgtgcttttccttatttaatcacatgatttgtctttaataaacctctactggctcccaagaagtgtggatcctggtaacaagagagtctttagtgcgctgaaggagtgatggttgtgaggatacaagagtggagaaatgagaagagataaactactatactttactaagaattggagagaaacaaagagtctagggtatgtggtttggaagaaataaagattcaagaggggagggtcttcttccatatccatagagcatcttaaacaaagtttatattgtccactgatgctctgtggggtggctttccttttgtggagtatgagtagcagtgttgaattttacctcaagttactatgggatagatagggaggctgctcttggataagtaataaatgcgttgcagaagttaagaaacagattccagaagtagagaaatctatgcagaagcatatagctagaaagtagcagagtggtaattgaacacaaatctgatgacagagccaatgcttccttttattctagcatgctgctagaaactggttcttttataatagtcttaaaataccttaagtctttgagatgagatgaaagtgaaatatgatgaaatgttgaagattgtaattgaaattatacaattacatatctctttcatattaaactttcaaagtcctggtactaatagcttgtattttaaattatgtcttcattgtttaatccatattgaaaatttggcttatgcaaaattatatgcctttgacaccaaaaagatatagaaaagatatggccactatatgataaatttcttatcctctctaataagaaataaatatttagtcccaggttttgaggtgttatctatactttttcaagcctaaaactttacacttgaaaattagtgataaatagttattataggtaataggtatgtattgacaagcacttgcttgtttagatatgatactaaatggttatttatttatttttatggtcaggtttctcaataatatatccattcataattcattggcttattaaataggctctatatttcagatatatggctacagataggagccctggtgtgaggcagaggggggctgtgataatgacctttgtttcagcagtgactcaaggacaagattccaaggctcagaattttgcttttattttctctgtatgagtgtttttgtctgtcagtaaacctgttttgtgaaatgaaacaaaaaaaggtttgtttacattttggattgcctttgcattagcattttatggcaattggtctggtttgacttaaagtcctcttttttcatctttaaagtgtgaggttgctacaatattaagtgcttaagatatgccactactgctctatcaaaattatccatgcaggtcataaattcgagttccaaaaaatgtaaaggaggtcatccttttgggcctccttcatgaggccccagcataccagacctaaccagaatggagtcttctcatgctaagtgccatgtaatcaaactgaacttagaaactagccagtttcgaaaacaggagtttcacagcaccaaatccaaaggtgccctgtcaacctgagctcttatacactgttggtagaaatgcaaattagtatagtcattatggaaagagtatggagatttcttcaaaaactatacatagaactgccatatgatccagcaatcctactactgggtagttctcaaaaagaaagcaaatcagtatatcaaaagtatacctgcatcctatgtttattgcaccacaatgcacaatagcaatgacatggattcaatctaagtgtcatcagtggctgaatggataaagaaaacgttacacacacacacagacacacacgcacacacacacacgcacacacagaggaatattattcagccttaaaaaagaatcagatcctgccatttgcagcatcatgaatggaactgggggtgattctgttaagtgaaataagccaggcatagaatgacaaatagcacatgttcctacccatatgtgggtgctaaaaagtttatgtcatggaagtagagaatagaatgatagttaccagagttttggaagggtgtggggctggggatgaagagaggctggttaatgggtacaaatacaccattagaaggaataagttctaatgtttgatagcagagtagggtgaatatagttaaaaataaggtattgtattttgcaaaatagctagaagcgaggacatgaaatgttcccaacacatagaaatgaaaaatactcaaggtgatggataccttaaatactaacttggtcattccacattctatgcatgcaacaaaatgtcacatggatgccataactatgcacaaatattatgtattaacaaaaatacttaaaaaagaaaaaaagtcccctctgctttaaccctataaggaaagtaactttgaaatgaccaattgggccaggcatggtgactcatgcctgtagttccagcattttggaagaccaaggtgggaggattgcatgagtccaggagttcgagaccagcctgggcaacatggcaaaaccttgtctctacaaaaaatataaaaattatccaggcatggtggcatgcgcctgtagtcccagctacttgggaggctgaggtggaaggatcacttgagcccaggaggtagaggctgcagtgagtcgagatggggccactgcactcctacttgggcaacagagggagacgctgtctcaaggaaaataaataaataaatgaccaatccacttcttattccttgtttcttctttctacagccctttttttcccctataaaagcctacctctgtctgcttagctcattggagcacctttctatttagtagatgggatgttgctcagtttatgaattgctaataaaagccaattaggtctttgaaactaaatttgttgaaatttgctttgttgatgccactattgctctttatcaaaatgatcccatagatagtctatagtcttttcttagtgttttctcccaaatctgttgggaagatactaagaaagttccgtaagtctgaaatctggtcctaaaactgtgtccagtaggtaccattgtattcaatatagcattttggtttaatcttgatcttctaaagtctgagtatgttctttagtttgtctagtttctgcagtcttgtgtactaaaagggtagtaattttcagttagctaattactatgctttacacagttatagggacgaagcattttagaatggcacttcattaaagcagtaaaaatactgtgggctcagtaatctcatttactgggtcaatagcccataatatctagaagaagatttaaagtagtttaaaaataattattcaaacgagaaagggatttcaaactataattaccatagcagtaaaggaatgaatgactccaaagcaaatataaatattatatttaaatcttaatatctgattgctgtaactcaaagggtttagctcttccaatactaaagatcacaagatcttagacctgaaataaacttcagcaagcagccagtcttggtgtagaaattaaattttttcctgaaaaaccacttgtagttaaatatccagactgacaggctttttgcagctcattcttctataagatgctttttttttttttttttctgagatggagtttcacacttgttgcccaggctggagtgcaatggcgatctcagcccactgcaacctccgcctccttggttcaagttgttctcctgcctcagcctcccgagtaactgggattacaggcacgcaccaccaggcccagctaattgttgcatttttttttagcagagatggggtttcaccattttggccaggctgatctcaaattcctaacctcaggtgatctgcccacctcagcctcccaaagtgctgggattacaggcgtgagccaccatgcccggccaaggtgttcatttttcttagagcatttgcatatctcttactcagttttttcccatgtatttgcattttcgttgctattgcatgttagatttcttctactgtggtctgttttttgtattgttttgttttgttttgtttttgctgatgtactgttggcgattttctgtatccatgttgtggctggttaccatttttaattctcctattagttctaatagtttttctctggttgctgtgtttgcaaggagaactactgtgtcatctgtaaataatgattttttttcttctctatttcagtattaatacttcccttcaccctgcctctgggtttctgtgattacatggagtagagcttccagaacagtgtaaaataaatattagtggacattcttattttggttccagtcctagtaagaatatgtctagttaagagcttctagattatgttccaaaccattattccacgagatgttaattgatttcctacaaaaaaaaagagagtcttctaaataatttccttgaactctgaattaaccaaaatgagacaaatctctttagtgaatgggcttttataacctttactatttaatatgcattgacaatctcctagagatggagaaagtatgtgacttttcccaatatatttgtcatagaacactgtttttgaagaacatttactaacatcttataaaacgatacatcagtggtatctttctggtattgttctggtagggtactgttaattgtgatgtttggggtttttggtttcaaaatgatgttctttaccgtgttaagaaaatatcctacttttagcttacttagagtgttatataaatcaaatcttttactatatgctttattctatctggcttttgctgaatataatgttttttatatttactgatgttgtttatttgttttcaatgctggatagtagcccttacacaagtatcataaaaatttgtgtggtttgcaatttgagggagtttaaacaatgctgctctaaatgtttgtgtacatgaaaattggtacacaaaaagaatacatttttataggacatatagcaggaagtagaatttctgggtcatagagcatatatacattcaggtatacagtagaatgctacagttttcaaaagtgttaatgaaaagtttacactcccgtttgttgcctgagacttccagttgcagtgcattttttttaaacactttaacttttaattaacaaaataactcttaatttcaggtaacctggtatatatgcagtaacatctcgtttttaaaattggcattttctggattatgaatgataaggaccttttcttgtgtgtatttgccattggatttcctctttaatcaataattgcatcttatgccaattttttattgttttggctgattttattatctatatataggaatttgttatgtattttgtatattaacccttcctatgattgtgttctccctctccatagcctgcctttcacttttaatgtcttttgagggatagtataattcattttatcagtcttttcttctactgtgagtgcttttctattttgtttaataaaaatgtttcctacctgatggtatgaaaattttctcctgcactttcatcttaaagcattactctattgtatttctgatacaggttttcaattcacctagaactgaaatttgtgtataagtaagggtctagattcacctttttccatgaggttattcagtgtttttaaaaatgtctcatttcctctgcccagtactctgtttggcactttcatcacaaacacttggggtctttattatgttgcatgggtcaatgtgtctgcccttgtgtccacaccatcttgttcctcttcatcaagggcattagctttcttggccctttgcatctctataaaaatgttaggatcagtttgtagagttccatggaagaaatcttgtggtatttggggattttgattgagattatcttgaacctatagattcatttgaggataatttacctctttacaccattgaattttctattccatgtatatgttatgtctctccaaatatgtagatcctttttaatatttctcaataaaatggtgttattttctccacagaggtcttgcacatcatttattagacttattcctaggtatttaatattttgaggcagtaatgaatggcatcttttcttaaatttttagctatattgaaatacaacatatttggattctgatttgtatctagcaatcctaactctaataaaaactataacaaattatatatgaatttttaataccatgatataatctgtagataattatatttttgtttcttcttcaatcttcaaactttttttattttttcatgacctcagtataatattaaatagcagcggggatagtggaaattattgttttattcctcattttgaagggatagcttccaaaaatttaacattaagtattaagtacaatgtctgctatagaatttttgtttagtaaaaacattttatcagactaaggaagtcccttgttgttttccttaaataacagttttaaattattagtcaacattgaatttcctcaaatccttttgctgcatctgttgagacaatcaaatgattttacttttgagatgatcatttgattttactgttaatattgcaaattacattaatttatttttctccccaactttttttgttgtgaagaattgcaaagagttgtaagtttctgaacaccatttttacttgaaatataacagccaacagacaaactatgaatatttagattttggcatttggaagacattttctcaaaaatgaatgaagtgggcctgcctcttcaggaaaataacaatgattttttagaatataagtgagattggggaccaaaagtttgaaaacttctgtcctcttagaaagtgtaatgttacgctgggcatggtggctcactcctgaaatcccagcactttgggaggctgaggcaggcagatcacctgaggttaggagtttgagaccagcctggccaacatggtgaaacctcatctctagcacaaatacaaaaattagctgggcatggtggtgggcacctacaattccagctactcagctactcgggaggctgaggcaggagaactgcttgaacctgggaggcagaggctgcagtgagctgagatcgcaccactgcactccagcctgggtaacaagagtgaaactctgtctcaaaaaagaaaaaaaaaaagaatggaagatacttaaaacacttctaattttatacctcctctcaagttgtatgctattttataattttcattataaaatttcctctttgtttttgtatgatgaagctttactataatgtttacatgtggatttattttacttgagagtaattgagccttttgaatcactgaattctcataaattctgaaaaattttcactgacttgcctttatccattttatctcttctctccctctgagatttcaaataaatgtatactagtccttctcattgtattctgagtctcttatcttatttttttaaatctcatgtttcattctgagtacttgcttctatcttctctttcattaattctttctttagctttatctaatttgctgttaaattcatttcttgagttctttatttcatgtattatatttatcaattatcgaatttctaagtaactattttacatatctgctccatcactttttatagttttcatttccctgcaaaatttttcactagactccaatctcattgaacatcgtaaacattgttttagtctatatcctgtaattccgtatgtggagattttatgtgagtatttttgttggttttctttaatggtggtttgtttctttttatatctgaagtttttaattgtgtatggggcattgtgcttaaaactttatttgtaacagtgatttgagacctaggatgatattatcttcctccagaggagatttttctttggttgttctaggtgtctaaagtcaatagaagttcaggaacacacaataaaattttcaaaactgaggttatcagacacaacaaattgacataaaataggttgacagattttataagactggtttattttcagttcagacttaatcttacaataactctaggaatcctagttcaaagtgaatgtttgtttacccttgggctctggattctgatttctattcttctaggcccaacatgcttccagaaacagagctcacctattccttccagaattactaatgcccctggggcaaaagcagattttagtgttagtgagctctagtcttctctaggctggtaatttcctaccatcttgttaagtcttcgatggtttagagatgaatttatatttttttttgcagctaagttattttccatagaagggcagtctgatatttgaaagttaacattgttgaagtcaaagttctcatgatggtactttttaacaataatgaagttgaatatcttctgtactttgggttttcattttgaaactagaaggcgtacttatagtacagctttcctggagcctatcccatttgcaatcacagacctttaactcaaagtttatgcaagccacattcttctccttattcctaaaataagcctagtcttagaatgtacaatgtaaatatatctctccttgcctccaaggaatgtacataaccccactaagacagtcatgcttccctatcttttccatttactaattttgccaccatttccttccactttcagtgtggaatccagttgctagtgcccatgactatttctcaacttccaactttcagctttcagtacactacgcaccatgatctcctgactagctgctttcttcattcttgcctctgtgttccagaatattatttaggcagaatacataccttacagtagcttcatcacatatctatagtttgtaaattctagctgaaacatcatttgcaatcatttttattctcaactctcttactcaaaatattctttttcaaaagttcatcctattttaaagtctgttaactgtaactcgaagtaccctatctctcatcaattaacacttgcttccttttagaaatataagagaacctagagtgaatctagttgaagtcctttcttataaagtaacctgtttcttctctcattcttgattcattgttcctgtttccaagaaagatgtatttctgcctttccaaagggtaccaatctaactatactcttaaattattgagtcttatcttccatgtattctcactccatcagtggtccttctcttgtatcgtcaatcattccatctttaccaacctcctcctctcaaactataagcccttaaagtatccttcagcccagaaagcaaaacaaaatgaaaaaaaaaatctgtattgagtgaatggcaatgactgttccatttaccactagctttatatgctggcaggaatcccacatgaaaattaagaaaatttattaggtagtatgattttccttacctccaaagaaaattctagccagagaattgataaaacctctaatgctatataattaaaaataactctgtaggaaatagaagttctcatgcttggcactacatgcagacctccagtatactctccatttgctcttcaaaatgtctgacttctagggctgacttcatgtgtaagtgcttcttgtcaatctgttagtatttgaaggataactagaaggatttcctaccccagcatcttccctaaggattcaaatttattgttttgttttcatccctttgatcaaacattatggtctcctctcttattgtttttaattcttctaggagaatgtttctcaaacctaggcatctattggaatcacatgtgggacttaaacaaaattatgtgcaggtgccatcctcagaaattgtctgtcttatttggtcaggggtggactcccgccattgccatttttaaaagttctcctggtcattgtaatgtatagccagttgaaaactatattcctagttgagtgacatgcaagtacactaataccatatagcaagaatcagttttcttaccttctttttgtgacattcctgtgtggcattttagcagcacgtcctgagatcatcctcctgaaaggagaaaaaaataatcaagaggtaagttggccataaaattatccaagttttactgtgacctaatagtaataataggatatgaattattaccataattcacatccatatgagaaaactctttcttggtttgagaaaacgtgttttttgcctcccagtctggagaaaacatgttgcgttcctctggcacatgtacatgtttatgcagatccattccctagaggaacttccaaataaacggagcatattatatatggcaaccgagaaacatagctttatgttgcctgttgtagaattatttcatgacattaacatttttatgcacccccatattaagttttatgcttagatttaatgtcaccaggtaggaaccaaggtaaatgccacatcccaaatccacatagagtcagagctaaaccatcagttatcaaatctgtctttttatgtgctgtgagatttatacacattgctttagaaagctgcattcactggaagatgctggtttgtggaggggcaaggaagtacatttacaggttagcttggctgaactgtgttgatttctctgcagaacagtcttcacaattctttgctcacagttaaaggtctgctgaaagtgactcagtgtagatgaaaacagcttgcttaatcattcctgaaacacgggaaaaattaaaatacatttttttatcaagcaataaaaacaatgccagattgttaatgcctcttttgtacctttcacttaaaagacctcaaaaagaacatcaaggagaataaaggcaaaatctattccccaatgccgtcattatacatgttgaagcctctaaaactagaactctaaagacattcaggaagagcaggggaataaatgacagcaaactgaagagtgcgtctctggagctttgttcaacctgctttgttcaaattcattcaaattggataatgaaaagcaaagatcttttttgtttcaacattaaagtagtaaattagtgagtggtgagttgctaattgttctgtaaagtatttaaggtgccaggagtgtcccatctccaatttttaaaatggcatccttatggttgaaatgaaaggaaccattagagtagtgtaaaacaatgtttttaataatttatgctggttcaattgaaatgattttcatttagaaatactcattgaagttcttgtttttacttgagataagcaagttttattttagacttcaagatatcaaatagaaattcattttccggatggggctaaagtagaaagatagattagagctatccaatgttgtgtttcaaatctggctgtttctacttgctttgaaggtatagaattagcaggtttggttaaattttacttgaattttgggtgaccttttctaatcctgactgtttcataatttagtgtcttgaccttcgttttccatagagccaccttagtgataaatgcagagatttaataactagaaccagttgacaggtgacctttcgtacatggctgttcctttttgctgtggaaaccactgttttgcaagttttattatttcacaaattttaattatttattctattgtctataagcttattcagagagaaaaaagtaaaggttaaatattacattattcttactgattaaaatgtaaagtgcttggcacttgtcccaatatatcactcagaaaggatagggcaatttgtcaggttcatacccaaagaagagaaagggatggttttcccagggtggttggtaaggatgaaactggcctaggagagtgagcaatcacatcagctaagtgaaggtaacagatgtgtgtgtgtgtgtgtgtatttgtgtgtgtgtgtgtgtggtgtgaattttgaatggaggaacagaagggttcttttactgtatgtgtaccaatttaaagagaaaagtgaccctgagtcaacgagaggtgaaacttgccagtcagggtgaataacctgtcagttttggccatttctctctctccctctctctctcactcactttctctcttacccaggaaagaattggttaagcatatcatggtaaattgatttctggaatctatgtcaataaaatatattgtttacaaacaaggaaataaggctgagtaattataaaaatgctagagacttttagaaagagttaagaatatctacactttccccccaccctacagtatcagagaacataggaccttcacagggaatcaattcctctgtacttacattcttcagtatttttcagaacaattcatttgtatgcctctcaaatactcatgcttataataaaataaaaataaaaacaggcatggtataaaaagacccatcgtgtgaacatagtaccccagtcagccattgtcctggatcctcatagaagagaagagccattcatgagttagagacctcttgacagtcttcaatgaacattgattcccaaggacttgcaaatggccactgtgaatttctaaagtgaatttctgaaggaggcttttgggcagtggggaggtattattccctttagtcctggagaccagtttagaaaataatatcatctgccatggtcttttttgcccgacatggacagtaattatttattgcttgagaatctttcactgctgttgtgaaagaaacagtttgaaaagcaaattgagtaagcagatgtgaaggaccatttaaaagctaataaaattggtcatgattagtttatcttagactgaaatttcagccatatttcaagctgaaaatatcaacaaaaacattttcaataattttttatgtcatgctagcactattgccaaaaaggaatagtggtgaagttattgattacaagcatgtttaaagcattaatctatgatttaattaaaataatttaaatataatagtgagcaagatttgaggtatctgcatatatgtatattaagaatagtgaaaatcagtaataattatttctttgatattccacatttcctaatgctgctgtgagtgcatttcctgaaagttaacatatgctcttctttttaacctgaaaaatatctagtatcctttggacatcatgtttatctcaacttcctcaactcagtaatggaaaatgaattaaggtaacttgaaaaatctgccatgaaaattatgtggaataatgtaataaagtactgagaaatatgactgacctgtaataggcattcaatcatgtgtatatcaaaaattctactacactatacttataggtctctctggtgctgtttcttcccttcctctctctctcaccttctacctgtgccccagccaataatcaagtcattttttcctgtaaggtggcaaaatgtcgagattcattttagcagagaaatgacttgttttacaaagccattccttaggcttctaaaacagcatacgaattgactctagttgatcatgaaactctcccacacagcttagcgctgtgtgctgagattaagttcacactgattagaattttaaaattattttactcttcacagtgccttgcacagaataggtactaaataaaaattatgtggttattcaatagatgtcaccaaattcttaactcctcccaagctgattgttttgaaaccagatgtgctggtatagagttagtatacttttgcagaggaaaaaaatagccaaaacaaatacagtgctgttaccataaaagaaaatcaatattttagaccttaaataaaaggaagtgtttgacatttgtggctttctttaacaaggacatagggacccagacagggttggctgaatatttgtggtgctctcagtttatagacacagctgaagcccagtgaaaatattttgaatgtacaagatgttttcaaagatgctttgagtgcacaagagacaagatgaagaagacaagtttgtttttaatgaaaaaaaaaaagcaaaaaatagagacaattcaactataaagggagaattcaaaatttagatgtggcttgataaagtggaactagataaatcttaacaaagttcttggaaaatccaggacctcagtctagaaagaaagagtaactgcctactgaagcagaactgagtgagtgaagacatatggaataaattttcaagcaaagcccccaaatcaaataatatgaatgagttgaagaaatagcagtacactttaacagagaaagttgagatcaaaagacgtagtaataaagctaataagaaaaactgagataactagataagagcagattttgggtcaaattgtccatttgtgcctaggtatttctttctttttgtcatggcatactgtagtttgaaggtgccttcagatgtataaatgagtcccttgggctttgcaagcaagctttttgtgctacctgaagctcctgattatgattaggaatgttccatttgtctggcccccacactcttgtcatactttaaagatggttcctgcaagtaagtggtaaaatagagcaattatcatgttcatccatgtctcctggtaccttattcaggaaggcagatggctaggcaaaactattacccagaagtatagaccaagaagtacaaacgtctcttaagatgacggccatggtgacagtagggccaagtgaatagtcaaacaaaaaaacaaagtggcaattttatagatcaccatctaccctcaaagccgttgcattcataatactctacccaatgacatatttgtcacataaacaagaggctgttgttcccaatgtttgccctcaagttgttagttagctgctgacctcataatctgcacagctgtggcatcccaatgtgttgtcatgaaacagattgtgatgtcttaattgatcactttcagaggttacaattgtcaagtgagaccagtgtgctggtctcacttaattctatattaagccttgttacagcaaaactggctaattcattataatgactaggaaatccaatgtaatttgctgcattttatagatttgaacatatccaagactttctttttcttctttttgattgtttaaatttgtggaggctataccccaaccatgcttttattacacaacgaagcaacttcttggaatagcaaatggaatgtaaccccccgcaccatatgcatcttggtgataagttggagtatgccatatgatacacacaatttaaatcaggcattgatttgcatgactgtaagtgaattggaggactcagctaagagtaatggatgtcaggctctgctgcaagccgtctggcaagaagaatattatgttcttctctattgtgtaaaagaaggtaggctcctaagaggttgaggaagggtcttaaatcaatgcgtgaccccaaagggcacttccttgtgcctccattttggtcactggtgaagtcttcactatggcactaacctataaaactctcttttccaagtgtcctaatacactcattcaccttgtatggatctattcccatctggtgcctggaccacctgctactcacattagttgagaaaccttactgtgttaggggtgatgaacagtccctttaataacagagttttaagacaactcataaatgggcctttgtgcattctgcaagtcaagtttttttcaaaagttttatctttgacatttcaaataaacacatgcctttgtcggtctggcacattttataggagtacaaataaaaatgaaatcaaagaaactaatttaagttaatgtaataactgttagcatccaaaatgcaggaggaagaacaagcatgtttatcaaagcacttttttatagtagaaaaaaaaacagataatagctaaatgcccagcagtaggcaaatcggtacatatggtatatccctataatggaatcttgtgcaggcataaaactatctctaagggctgacatgggaaaggctgatgatttttgattaatggtttctcattaagtaagaaaccaaggtggccaaagaatataaatggcatttctcaacctgtctaaaataatatctatagaaaggaaaaaaatatgacaaaaatcggtgtagtgttattgagtgatgagaatatggagaattttttaaatcattttgtccattctttttagtttttgagtttcccatattactttactaattagggggaaaaagtttttaaagcagtttgagtagtttcaattcaataggctgtaccttcagaatatttccagaacataagcggcttctctccatctcctttgctactcaacatggtccacatcactatcctctcttgctgggattgtagcagcggcctaatctcctgcttccaccctggcctcttttttttatcaactttccacacagttgccaaagctgttaaaatgtaactcagctcagtcattcctctgtcccgagcccttcaatggcgcttcatctcacgcaaactgaaagaccccaagtgatttctcccctgctatctgtctggcctcagtacctacttggctctccccactggctctgccaggctacattgctcttcctattcctttcctgcctcagggtatttgcattggtttttgcatttgctctgcaggaaagcttttttcctaaatatgctcatggccaactctttcacttcattcaagtctttcctcaaagattattttctcagcaatgtctttttctggttactccaccaactctctctctctcacacactcacacacacacgtgcacacacatacctcttaacctcctttcctgctttaattttctcgatttagtacttagcaaaatttaacatattatatgggatgatagtttatttattgcctttctcctgcacccaacttgaatataagctctatgagaacaggagtttttgtttatagttttcactgctgaattctaacccctggaactgtgcctgacacatcgcaggtgctctatgactgctgtgagtgcctaccattgataggaacaatggtctgttacagttgtatgatgactaactggttgatttttatgcagtatcttacctctcagtgtagttattttaattcaattgctttcacttcctaacttaaccaactgagcctttaatgtattccagggactgacgggggaatggagttaaaatgaaaaagataggcattgttctgacatagtttactgtctagtggacagacataattaaacaataaagtccaacacaatacataaaacaaggatagtacccagtcgagagaggctactcaccaacaggcacaataaaaattcaagatcgaatgtcagatgcaaaatgtggaatctcatagaagggagatgagaaagatgtatatcaaaaaagcacattgcttctttattactgttttaaaagaaagggtgactatgtgggagagaagcagcaaaagcaatctatttggttgttttaggagaactgaaagcaaggaataacggaaagggcagtgggcttagagttagacgatctagatttgaatctaacactgcagctttatcatctccaagtcctgaaagctgatgcttaacttccacgagtctctattatctccgtggttaaataaaaagggagaaagggacttagactaactatagagactgtctgtgtatataccttcccatctaaaaggaggcctttccttatccatctaggataaacataaacacagacgccaattaatatgatgacttgagggaatctctgaagggtctctgtaatatttctgctagcctgggacttaccttaagtagttactggttctgaaaatctgttttataacctcattgcttgctgaactcttcatatttttatcaattgctcataaccattcatgcatacaggtaaaatacataattgatccctggatatgtttcttttgcatttcctttatagccaccaaccttattacaaagatcaaatcttttcgtattttcttatttcacctgaaattacagttctgaataaaaatatttatcatttagagtggaaaacaaataactattttttgcctataattttaaaccagggcgtggggattatagaaattaaaattattttttgacggtatactttttcttttttaatggaagcatgctgttaacttgataatctgtggcagcgactgtaggtttggtatttgtaggtacttcagagatatttccatatttggtaattatacaatatatgaacttttgttttcccataggaacttgtttgactaagtggaatttactaatttacatgccttctttctctatttttcagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacaggtgagccctctctgaagcagctttattgtcttttattatcttttatgctaaatcttcgccaattccttttgcaggatataaaatgaacagttatttatttacgctgattgttatatgttttgactattatgattacttgataagccagcctgaggtctcatttattccacctatactacctcctgttctttccattctgattggtttgagtctccaagaaacactggatacttccccaaggtatcttttgatctttttttattttgttccatttgctattgattgagttggatttcagctgaaagaggaagcctaaacatttctgtttcaaaacctagtaatggtaaggaactttaggattatgcattaatctaaactcctctgggaattttgccaaaattttacctgagaccacaaacagaacaggctactgattctccaataagattgtgtagcttcttgcatgcaaataggcactgtgatcctgaacatcataacttggtatctaacttgttcagcagaataccatattgaaattatacgtcccttaaaatcattagcagttgaattattttaaagaaatgaggtataaatactattcattcaattatccaaaaaccaatttgcattttttattacatccatgttttttctgtagcattctgtaaactacacttcgcacttttttcccttgaagcctgctttcccctccccttccttctcctatttcctctgtttgctccatttccagctccctcatctcttctgtaactgaattgtgtgccatgttttctttctttttagaaagataactattaaaacagagaaaacaggaattacaaatcagacaatcttagttcttatatctagcgctaataaagaactgttaagggaagatattgaaaccaatagctaaagttttaaattatctgtgaattttgcttatttgtgcaatatcatggataaattgagcatctgctatagttccaatattagcattccaattttttcaaaatgtatgtatttcactattcaatattatcaaatctaagcttttaactatattgagctatgtgctcagggaggtgcagtttctgatatctctggatgtaatttgaatgctgatgattacttaaaaaccttaggtggatcaactctcctttggtaatgtgggttgatctgaatttaacattttctacttctgagcaccaaaaatacacagcttcatatgaaatacaagacagaaatagccatgaaatactagttcctcggactgtatgagttagcaagaagaatcccaagggtgagatttgaatcaatgtagcataaactgtccaaaatgacaggcagtagagatgaaagggataggtatggtgcttcaaagaaaaatggtcatatgtcacattattctatataaatatgaagcctattcacaaagggctttggaaatttctgatctctccttagcccagagcaatgcaattaatgaaatgtattttggtttttcattagttagagttagccctcagggtatcacccagacatacctataagccctagagtcatttgcggggaggtatcagagaagagcttagcatgctgttggttcatgtttttatgtgtttatttcacattgacttttgccgtgagctttgagggagacaacaccatcacatatgtgtaaattgtaaaagaattgggagagaatagctttgggagatcattttcttactggccatgatgaagaaagctgtatcgtaggaaaattactaggtaattttactcacttgataaagttaatttgcaaggtatcattcgattggtagagttaccaaaatgagagttaaagaaacagaaatatggtttcagtttatggtgcattcttatctttttcactgagtctatttctgtctggttgcttcacttagtactccaaccagacaagagaagacaactatgctagtgttttagaaatggacagaatgggtgatttaagtagagcctggttggataataaaatgttgatcaaaatgacctcagaagctgctgttcccaatctatatcctaaccccatctatgttaaagacttttattgtctaagaatttcccatgacaatctgatattcattgtcaaatttcaaactagaatatatttttcaacttttcatgaaggaaaatgtcaaacttatagagacactagtggtgtaatgagcctctgtataaccatcacttagcttgaataattattaattcatgaccagtatggtttcatctatacccctacacactttctctctcaccaaagactatgttgaaacaaatctcagatatcatataattttatttataaatattttggtgtatacctctaaaagataaaaagtcttaaaatcaatacaataccattgccctacataaaaatcaacaattctgccttaatatcattatatatttagtttgcaaatttcccaattgtctcattgatatatttttcatagtttgttttaattaggattagcataaggtttatacatagcaattgattgatatgtgtcttatatttctcctaacctatatagaaacttccctgtctctccttctctcttctatctccctccctgcctgttgttgaaaaaacctaggcattagtcgtacagagttttccacaatctagatttgttaatcacattcccatgatctttctttttctgctacactggtatttatgtattgaggcttggttggattcatgtcttttttttttttttttttttttgccaaaaccattaggtggttcttctctcagaagaaatactctctagttttctctttttttaatgttagatgccattaatgattatttgctagattatataatgtattaggattgcacaatggtgctatttcatcttatcctttttatttattagctgatatattttattaagagtaatttaccctcttattcatttggttaccatgagatagaaaccaatcctgttctcctctttatttaccagttttaatgtattagtttccttgcattctctataggcgtccactattattaatatttacatattgacttacagacttaaacatacttgaagtattttaatttattaaaattatatccttatgctcagattgccctattttggcctatgggaacctcttcaaattggctttgagtccttttgacatgcccttagtagtctttgatagcttctttgtttcctggtattatggaatgtttcaggctttttttgtacatattccgaggcagacctggattcagacatttctgcaaagaacgtcagtttcttttagtagttaagagagcataatattagcaccattgctgctcattgctactggattggtctttgtttcttgggctttacagaggacagaggtagtatgtaaacaatatatactgtgtatattgtttaaagataaaatcgttatgagttcaaaccgaaactttcaattcaaatccagggctatcaggttttaagtttacatcctctatcttatatctgttccttctttttaccatgctgacaatcacaggtctcagagatttcaatgtaattattcatctgctttattccacaacacacacacacacacacacacacacacacacacacacacataatcttagaataagaataacagcacaacaagcaatataattatggtaaacactttaaggatattttgcatcaaagaaaacatttgaatggcaaacatttatgtggatctgtgctcacaaagtatatgttggtaatagtctccaaaaaagaacatttttctcctaagtaaataggagtgaattaagtggtatacatcactgaagtcatgaggaaatagagaataaggggtgtccatttaattttgctttaactgtaaagctattttgtttgatttgcctgtagttattagaactttttagcaagtagttattttcatcatcaagtttttaacagagagacaatgtcatcattattatgtataatttatagaattaaaaatatgtcactagtagttaaagtgattcatgataggaaaatgattacatggagttcctcaaagaaaactttgcttctcagcttgcttcttaaaattgtaaaaatacttaaaaaaaaatatagcccttccgtttaaggtaggcatcttttcacttttccaagtattgtgggttttgttttttttttttttttttgagacagagtctcactctgtcacccaggctggagtgcagtggcatgatctctgttcactacaacctccgcctcccaggttcaagtgattcctctgcctcagcctcctgagtagctgggactacaggcacgcaccaccatgcctggctaatttttgtatttttagtagagatggggtttcaccatattgaccaggctagtctcgaactcctgaccccgtgagccatcttccttaggctcccaaagtgctgggattacaggcgtgagccaccacgcccggccagcattgtgttttttttcttaaggaattcctcactgaggaaacatgaagcagtagaagaaatatgtatatcatttaaatgtcttagaataagtttaggccaactcacaaacatattggaatacctttttgaagcaaatggaatttaatttgctttctttttagttactgtctaaaattatttggcttgtcaattagacagggtgaccttgtgggaaaggctaagagagcagatagagtaggttgctttccctttctgtctttatcttctggggcccagttgttttttttttctttctttctttttttttttttaattctaggttcattggttagtggtcacttttagattgtcacctaccaatatacttctggaaaacaagtattgtgaattctacagaactttcatttcttccagaaatctttgaaattaaaggttttatattcaaaacaacctggaccaaaataccttttcccctttgaatgattggtatgcataaataatactagcctgctgacatttacacatttgcattaatacatcttaagactgaaatatgatggaaatgctgtagggctgatagtggcacattgtgccacacttaacaatgaagaatgtgatcatgttcctggcacacacatatgcaaaaggaatgttaacttttctagagaagcagttgagagccaatgtgagatattctgctttcctatgggtaggtgggcaattgcagcttggatttcactttagaaatatgcttgcaaatataggcacattatttaattaagtaataattgagaaagcgatagtccccattaaaagagcaaagctaattctgggctgttaaaggactctgagctgccctaaataggtcttaattagctggtgccaatgtggctccaccttcagggatggatgaaattaatgaaagctagcagcaaatagaatcaatatttcaagatgttcctgcctcaggtgaagaggatgaaaagaaagggagtcattttcaaagactgtttaggaaacaatgcacataaatcaatttctaaaaacataaaatgggacactgatttgtgaatacagtatcaagatctctacctggctcatctttgccagcctgttccatccattcccactcaatcttaaggagagaaaaagaaatcagcgatgtgtcattcctcactatctttgggggtgacagttttataagctagcaagggttttaagggcagcccaggttttgctatttcagcttggccattttgaaagtttcttgtgtcattgcgtggtcaagtgtagagatgaaattggctctcatccctcaggtttgcaaacctttagtaatatctagagtggaaaggggtttcaagtcttcttccttgaaaatttgggaatcctcttgtaggtccctctgtcaacacacaaggaagccgccttaacacacacagtgtagcttgaaggtggagggcaaaaaccaaaaccaaaataaaacaactatgctagccatatcttagagtcgccatggggtacagaaatgtgcatagtttgcccgaagaaatgccatacctagattccacaaacaaagatgtcaggttattcctaactcagaataaatacctgctaaccccaggaaaacttcgaccaagagataataggcaaaagacagtattaaaaacagtattttccatttttttttcattttgaagatggtctttgcaaatataagtatctcagcactttttcaggagcaatgctgacaaacctctgttagaatgaattaatatccccatcccagctggtgtatttggcaggaacaaaaagttcatgcagcagtcatgggcagatccataggactccttagtcaaaaagcataatactgcattcagggttgtgttttcacgctaacaagcattatgaaacaggggaacttcctttttaccattatttatgatggcattcagtgacctacattaggcctcctctgtaatacaaatgcgctggaaattaaaaattcaaaaaaaaaaaggaacgatctattttaataatgggaggtagggaagggcatttgtaatttataaagatatcagtacaaacctttcatgtgtttaaaaacaccctcatgtgcacacacacacacacacacacacatatacaaatgcactgggtgaaactctgatgtatttgacaagacaatttaggattaaaacaagagcaacatctcaagttcagtgatcatattttaaagcaaaaagctgtgcaggacatcagtggttgtggaaatcaagacttccaagcagtctactgagtgaaataaagttctctgggccagaggatgacttgacagaaggccagattctcagaaaaaattatactgtatagaaaaaaaatcccagtagacatgtatgctcaacagttctctagatgtagtggcttttaaacccccaaagggtgtgaaactcaaaggcaaaagtaggccttaaatgggaagcttcattaaaatgtatacagacttttaaattttatacaggctttaaagggtttatttatttatgcatcatgggatctatctctgtagttgacttacttctctcttacaattatttctcctctccttagatttttttttgacctatgcctccttcttcaagtttagttcaaaattaagacaagtaaggatagttacattcttgtctttaaaacatatgagccagcagcaatctctgttttttctctattcttggatgcttgactctttttaagacagagttggttgttttgaaaattttcatcctatactacgcccatctgtactactagatgtttaattgcttgggcaaatatttcaaaatacctttcactgtgtctgggatgttataagagctctacagatgtttgccgaattgaatttttgcttctctgtaaacagacttcttattagatatggtattactgacctacatggactcctctagttagctctttttctttctttcttttgttcttgtttgttctttctttctttcttttttttttttttgtttgtttgtttcaaggagtggaaagtttaataggcaagaaagaaggaaaaagctccccgtgcagagacagagggaggggtgctccgagcggagagagaaaaaccccatagctccttttcttagtgaagagtaggtcctctagatcagtacagtgcttttcaaactttaatgtacatcaagccacctgctgacccaaatgatttgaggcagggcctgagaattttcatttttaacaagtttccaggcccggccatcctgttcatctgcagatggcactttgaattatgctattaacaaagtaaaagacattcattttttcttgaaccaaataaatacacaagtcaagaatatctgtttcccaaatagctttgtaatctgcttgtagttggatcctaactttgtgatcctgccctattccttagcaaattaataatggggctcagagaagtccttaagaattcaactggagacttgtgtatctgaattgtgtttatgtgttcatttctttcattgaacaacaacacatgtcctaaggacagggactacacccatctccattttattctcagatctagcatagcggtggttagccataaaatacagtaccaaaagaatgtattattttcactctctgtctttcagttaaaggggccatggatgtttcaagtgtccttaaattgacctcagcagtaactccttttctttgttctattattatcactaccactgctctagtttaggccttctttacctcacacatacgtgactgcttatctagtcctacctctatgttttggcagagatagttccctctgcctaaattgcacttccccctgtcaccatgcacacacatgcaggccatactttatgaacaagtcaaatgttaccttttcatgaagcctcttgtaatatccctacagaattcctacttcccctgaaaatcgtagggttatggacttccttgttatagaaataataactttctaccatgcgttattgttatttatgtttaatctcttcaagtggtccataaactatttgagggaataccagccttgtttctccaagcaccttgacataatgcttgactttaataggtattcagtaaagatttaatgggtgaatgaataaataaatggacgagtaaaagaagaaataacacttaatatcttttttaagcttaaaagtccctttgccattgttgaaataccagtgaatttcaaaatactttttttcaacaagaagggtcacagcaatgccaaagaggcaagttctaggattggattttgatagaaaagtttccacagttctatttagagagaccacgtcttactttactttacccaaaggctggcaaatctattaccttctctagggattttgtgattgggcactgggtttttaataagtaactggcagagccattcctcaaatacaggtttccattttagtttcacttcagttgtgaagcaaattccaaggcttcactcacaattctgttagctgtcagttgcctggtgagaaagcaaatcctagtacccaaagtcaaagttatactcttgggcttcaggaggcaaatataagcaccaccacagaagtcagaaaacaaaatacccaagtaaaggagaactgaaaactctcataaaacaacctgagcttctctaccaaactttaaattgccctccagaaaatattttcttctttggtaacaaagaaaataaattgccttactttttaaatgccttcatgatgaacataaagaaaagaaaaaattggtagttgtgtctttcaaccaactgcataaatgaagaataaatttgtatatagactaagaggaaaattaatgaaagcatttctggcatattcagatcatgtcactctcctgctcaaaatcctgcaatagtcctccattttccttagaataaaaacacgtgtttacagtgacttccaatcacttctgatgagtctaccatgatagcatttaaaattgaaatccttacctcacatacccagcattcccaattttccttaccttgttctattttatttttttctcttatagcattaccttctaacattctatataatatacttatttattttaatttttagtgttttctatgtatttctcctactgggatatgagttctctaaggccaaggatcattgttttgttcactaatatatctcaagcacctagaagaatatatgttgtgtagtagacactcaatatttgctaaataaatgacctagaggtggaaaaacaattgaataaaggattcaggcaaacttgcaaaaagttatcatgggggtctttaatcgcttaaagaaaaaaatgcatccactcagaaacagtgcaattaagttacaagtttaaggctgttttttctgctgttgttttacaaaaaggtgctagtattgaagctgtcttatccaagagatcatcattgcactcaaggaactggtctgactgatttttattcttcaacacatggaccagttgtttaaacagaattgatttctgatttctttggtatccaggggaaacagcaaaaatgtctcattcttatttggattagtagaacagcggttctcaaacgtgagcttgcatcagaattacaaggggtgctgattaaaacacagattgctgggctcattcctggactttctgggttggtatgcttggattgaggcccaagagtttgcatttctaacagaattccaggcaatgttgctgctggtcctgggatcacacttcaagaactaccgtgataaagaattctaagatatcaagtcacattcaattattttgaacatttggtcctataatctttattctattggcatattgttgcacgaacatctagcactatttttgttatgatatttttcacggcgaggagttttttaacctcctgtgaaagtcctactgcaactctgtcattttattcttcactttcttaagatcttgctcctctgtaattataccagatggtgctgctcagtagcttataagggagtgatgcttcatcattctagacagagagacaaatcactctgttctctgacttttgaatcaagaatcaacatttgtgtgtatgttcaacctgctatttgctttgcaattttgctcattaggtatttattaccctgacagtgtatgagttagtcattttccttctgccgtgtagttcagattagcactgtttgacaactgccatcatcacagcattacctccaataatatgtaatttcttttttgcctatgttatctgggtgaggtagttatctaggaagtatatctacaaacggaagatcacaaacagcattcagttctctgacttatcatgttagaaatggataactagggccatttccttggagtttctagccctgcgattggcattgctgaaaagaaaggaatattatgaccaaagccaagcgttctttttcatttattgtatgctttttttatgaagaaggtggtatgagggaagcatacaatttaatgagaagcattgaaaaagaacagaaacatttattaagctctactggcaaaatggataggcaaccctttacagaaacatggaaaccatgcagagcagagaactggttaaaatttagaatgtggaaaacagtcttatctgagatattcaacaattggagcaaaaacatattttctttttctttataatcttcactaaaaggagaactaaagttattactagataactcatgcaaaggcactattacaggcatgtaataacattcttctgacgtgaataggttgtttattctctcctaaaatacttctctacacagttttaatattaaacttatgaaattttcttgaacttttgttgattggagggtagtagagagagaaggggatatagttgggagcttttgggaaggattgtcaatctatcttaattcttctagttgatagtagatttttgaccattaaatctttactaacaaaggtgttaatatcctcgtaatgaaatgagtgtcctacactacatcagctgtatcattgtggaggtacaaaagctccgaaggtaaatgcaaaacaaagaatggttgctattccaaggtgactttttcatgacatgttctatatttctgatatgtcttctagtcttaacctgtgagttcatagcaaacacagttggttttatttaggagtgcattaaattttattccattgagcaaatttcacttttgcttcatagtgattgtaattaatttgctctttatcttctctttatctttacttcactcattactcatctgacagctcgccatcccatcttaattgggagagaagacccttccaaaagtgaaccattggcagttctgtcatctggaaagagatacataaaatgtgttaagaaacagaaatgactatataactggttcatcatatttccttagcaggtggattcttggtgggcaaagatcatgttcctggtgcttttgctgccaagcacattgtgggtgttcaataaatattaaataataagaagagtttcctaattaagatgaacatttttctctattaagcagatggtgctcaataggagtaacccattatttataagtatgacacaaggtgctggcaattgttgaggaaatgtggctctcacttcagatgctgattatatgttaaagcaaacttttgtgacaaacagcttggtcgatattagttaatgtttgtgattaaaactgttactaaagatggacttgtgtatgtaggtctgtaattctgctgttttgattcttaatattggcttcacctattcaagtatttctggctatttgatgcaaggcaagtttgggcaaatcagtgtatacctgattttaccccataggttcaccatttgatttgaattctcatccttgtctgatttctaaagagatttttgttttgagtcctttgagtctctttgtggttgctaaagctagatgtgaacacctccgtgatatttgcaatgcttatattcgtagctgaaatctcagtggaactaaggagagttaattaggcattcccaaaaatacacatcgttttatgattttgcagatcaccccgatgaaaataacagtttaattttgtcaagtcatgtaaattatagtgagagggatgatgagagttctcagctctttggagaagttaattttgttgtcagcacatccacatttcaaaaatcacaaactagaggcagaacttttcagtgccagtgagatttggtgatcagatactgttttcatttctaatgtctgccttctgtatagcgcctatgcaaataggggctttcaaggatgcaaaagtagcaacttcccctattaggagcgtaactagcagctgctgtgtttctcataaaagagaaaacatcctgtttactaacatacaaccatacgccctcacccgcgtacactcacaccaagctctttttttaaggcagagcttttattttggtttgagataggcagcacagaaatgcagtcttttacaaacattccttgagcacatatcccctgggtgctaagtaggtgtcagtcattgttctagatgtggggaatccactgatacttgaaacacattctctaattttactgggaactcgtcggaacttctgacattcattggcaagttctttgcatctggtctcacctccttatttttaatatttataaaccatgttcatcaggatgtcagtagagaagaaatgaaagtagctgagaaaccttgccgagagagaccaaatctcaaagtgaactaaaaatgtcttgaccacaaggatagaaagtgaactaagatatgttcttgaggcagcaaaaataagtattgtgccaaaatccaggctttacctcagtgtcagataatcaatggactagagatttcactgtgttgcccacagccctgttaagaaatcaagaccatgtgctttgtctataatcctggagtcagcccagaagatgagctcataaatatgttagcttaagtaaagtttatgataatatagacgatgaatcatcttcctgttttgaaaagcatatattctataactcaggatttctggagtccctccagaaatctacatgacttttgccccattttctttaggtcttgattcaaatgtcgccttataagagagcccttttttgacaacactctcccacccccaactctcccttttctgcttttcaaactctattttcctttatgttacttgttatggcctgatatgtgtttgctattttctgtcttcccttattagactgtaagcaccatgagggcataacttgttgtttacctctctgccccctcaaatagcatctgacacacataggtgacactacccagttgttgagtgggtaacatgaggttgtttgggattgttagttcattatcctaggcctacacagggtcagcatcaccaatatcgctgtcttccaccttcacatcttgtctcactggaagatcttcagagacaacaacatgcatggagctgtcatctcctatgatagcaatgccttcttgtggaatactgcctgaaagacctgcctgcagctgttttacagatatatatatatatatctgtacatatatatatatatagggagagagagaaagagagagagagaatgccctctaaaataatgatgaaaaataaagtaaatacataagcctagtaacatagttgtttattatcattatcaagtattatatactgtacataattgtatgtgttatacttttatatggctggacatgcagtagtttacctaaaccagcatcaccacaaacacatgagtaatgcgttgtactatgatgctatgacagttacgacatcagttggctataggaatttttcagctccgtttataatcctatgagaccatggtcatatatgcggctcatctctgactgaaatgtcactgtgtggcacatgattgtttaactttcatgagagattctgataaccaggggaacattgaggtgatataatttaatccaaaaaagtagatgtttcaaataagattttgtattgggtaaataaatgattactgtttggctttttggaatttcatgcatagctcaagaatctctgttgccaacttcatggtctccttagtggtacagagatctcagcaaagaaactcagaagtgagcacaacacacttatttaatgggtaaggaaacctaagaccagggcaaatctagtgactttctcaagtcccacctcttgtagtgaaacttcattcatggggtcttatgaatcctaggctagtgtcatgtttactggctcacaaggactgccaccattgaattgagcaccaggttgagtatttctcaaatgtgctctggggaccatctgcttcagaatcttctggagggttctgctagaaacatagcctctcagccctgtggattcagaacctctgggaatggctctgcatttaaacagttccccaagtgtgtcttacacattcctatgcctggagaaccagtgacccaatatgtgcaaggattcttgattctcctccatggaaaaataaaaaaattaatcgtatctccaaactatatgagtacatatctatcgagaacctggaccaacagtttttcttggggagggacactggtccatattaaaattaggttagttttaccatcaagttggataatatgagctactttgaacttttgggcttaaatctatctagttcattaatttctgccacaaaatttttaagtgcacattgccaggaattcagagataactgagacaaccccattgcagttgggggagacagatatagtttcacagggctacagaaaagccccgaagggcctgtcttgtctccatgtgagacctcagaaccatgtaatgcaaccaaccttagttgcatagtaagtaaccaaccaggtgtgtatagtaagctgcattcctaaatgtctttctatagttctggacatctctctaagtccaccaaatagtctcagtcttcacacaaagaatagtgaggagatctgtttattctcagagttagtggacaaaagcaaatattctattagatgttattagtattattattgttattattttcaggacctacatccagccccttgttgccataatcgctatccaatcacactgcccttttcctttgttataataaatttctcccactcttcatcatctttgaggatgaatcatacggttcatcagcatcttacttcctgacatacaaccctgaaattgaacaattcaaaaaatttcccagaaatgactttgtgggattttaatctaattctctgaatggtgaaaactctttaagacatttttcaaaggccaggtttttaaatatttcataccatggaaactgtcttaggaaagagttggggacttaaggtcacaaaaaatgagaaaaattatacttgagaaaaccttgtaaactagaacttcttgtaagaatattaatatgttatttttatccatcttaaaatttcctcaggcgtgtgctgaatgagcctacttcatggttgtagttttgttgttctttccacgttattttgcagttctccctgtggccatcatattgattttaacactgtggtcatcattataggaaaatggaggcattaataacttggtctctgtggacagattgtaatagaaaaccttataaataattgcccactaatgggaaaattgaaaatatgcactgtattataatggtcataatgtaatcattaaaattataattatgtgacaatgaaagaactcattatgcattagtttatctttacataatgctaatagctaatgaaagtgtgacaattagatctaattaagtttaacaacatttctgcacttctcgtaaacaggctatgttttgccagaaattgtatatgcggagacattagtgataccgaggtccatctcatataatatgagttttgaaatgtaaccatcagtcctatgaagaaccttaactttataatgcctttttgttaaatgaactggaagtatgagtctttactaagggtagctttataaaaaagtttctcagattgtgtcatgttttagttaaaaataacaattagtccttcctcttctactaatctgtgcttatatatttgtgtgtgtgtatgtgtatgtatgtacttgactcatctgtgttttgtttttaacaatagaattgttatactgaattctcaagttagaggtttgattgattgatgataatgaatcaagtagatgttggtttcttgtcatagattatagcatataacagtccaccatgtcctatctgtatgatctaggtcaagtgtaaactctctgtgcttcagttttctcatgtataaagtagtgtctatacttttgttagaattaaactagaaatttataaatttcttagcctgggcatagcacatggtgctagtatttactattattagtaggaattattttatatctatatcataatatcaagaagaattccagctagtatcacttttcctccactgacattttattgcattgcacatttagataatcatccagacttttatttttccatcatttagaaaaatcattacatacatcatattgaaaacagtatagggaccttcaatatgtgctcaacatattcttcagagtggagttttaagactcttgagcactggaagacattggccttgtcaccagggtttccaactgctcaggtttcacttacagaatgatagactgtgagctcaactatgaatgactcttggccgctctcatcagtcttggatcatcaggaagcctcagaaaacagagactgttcaagtaaatacaggtagaaattggcaaactcagtcacttgctaccatgcttccaaaaagccatgatactggtctttacttttctaccattccttttattgatatatgttcagtacaaatgaaacattctctccccaagaggactcattcacttccataagtcaaccatcactgctacgtcttgtctccatctctgctatcacttctaaacattggtctctaaaactaggttggcctttaggcattttctgtgtgaaattcaatctgtttaaatttgacttatctttcctaacgaaaatgtaattgagttaccaagtccacagtcacttacttcaaaatattctttgattatatgctttgtttctatctcgaggctctcattgtctcaggtctagactatgaaaatagtctccatctattctcactgctttccatcttttgcccttcaatctgcattttatacttccaccagattaatcttcctaaatcacttttacatttcattcacctacccacaaaactctgatggttcttcattgcctttagtttcttttatctggcattcttgtccctcaaagaattttgtccagcaatttttctaagtttgttgccaactagtccctacagttgttctctggcccaaccacatgggtctgctcgttatctccagatacacattctaagctttgcatctttgctgaccctgtttctcagctgaaatgctgttccttttctactcttgtcaaataaatcatttaaggcatagctcaagagttgactttttccatgcagctctctctaacagccccatttatccctccctcctacgaattcctcaagcatttatttttctcgccctgtatcttgcacttgtacaggctagtttggctgcttcttatcttttatgtacagttccagctggccaatgggattggcaatattggaagcccctcaaggctgttttttcatctctctgtgcagagttctcagtgtatattaggtccttaacaaatatttttttatgagagtgtcaatttcgtaagcacttgaagatagtactaaaaagccttcttgccacttggttctgcctggagctgatttcatacttacaaagtaatgatttctgagccttctgcttatagaaatcgtgtaaagcctcttggtagaatgaagcatgatgccctctaccctgaactcaaagacctttttgggaaagtattattttagctgagagtttaagggagaggacagacagattcctgtgatgcagagatcagcatcacagccctggcagccccctcctcttgctgagaacagctgtttcaaatgcccattttagaagggcccttaactttccttagggctgctaagagcaagttctggatcacctgtagctgctgctgcttagataaccccagaaacaaaagcaggtgaacactgggtatgcttgcctcaactttgccactaactagttaagcttgggaagccagctcacttccaacagtctcaaatgctttatctcctctgccctaaagtgggtgaagagctccagaattaaaatttgataatttttactttatttttaaatcaaaggtagctgaaagttgaattttgattaaaaaaataaaattcaagacaaatccacctgaattttgtagctcttcatttcatagatgtaaatctatcacaaattatcattctgtctttctttctgtctctcagttcctctccctttctgtctctctcatacacatgcacacatatacacaaaatattccataaaatcagtttttaccagaaatctctttcatgctggttctcctctatgtagaaagagctacaaatgaaatggaacatgggaatagaacaagaagctgattctcttttaaattgccttatttgttttttctttgggaagtccgaatttttgaagacttaatacaaccctgccccaatataaactgtctctcgcattattaacatcccccccgcccagagtggtacatttgttacaactgatgaacctgcagtgacacatcattatcccccagagtccacagcttacattaggcatcactcttggcattgtacatacattctatgggtttatacaaatgtataaggacatgtatccaccattataatacagaatagtttcactgtcctaaaagtcttctctgctctgtctattcatccctctctctcccctaacccctaacaaccaataatctttttactttctaattgttttgccttttctagaatgtcatatacttggaatcatacagtatgaatccttttcagactagattctgttacttagtaatattacactcctttaaatttcttacttattacacccatttaaagttcttccatgacatttcatggcttgatagctcatttgtttttagtgctgaataatattccattgtccgaattgtaccacagtttatttatccatttatctactgaaggacatcttggttgtttccaagttttgtcaattatggatagagttgctataaatatctgtgtgcaggtttttgtgtgcatgtaaattttcaacttgtttgggcaaaaaaaatgttttatgttatacgctgaaaaatgctggctgaaatatgtagctaagttgcctttattgcctttttttttttttttttttttttttttttgagacagaatctcactctgttgcccaggctggaatgcagtggcacaaacatggctcgctgaagccttgacctcctgggctcaagtgatcctccctccgtagccatccaaatagctggaaatacaggcgtgtgccaccatgcctggctaatttttaaattttttttgtaaagacagagtcactccatgttgcctaggctggttttgaacttctgggcttaagtgaccctcccaccttgacatcccagagtgctgggattacaggcgtaagccaccatgcccagcctacttttgtattctcttataatgttgagtgacttaccttttgggagttatagatattagatacaacttgaagtctttttccttcatttgtaccatcaaaagatgttttcggtgttcaatgaaaattgtttcaaaaggaatttggcagtccccaggcttctacaggcggttttgaggatgaaatgtgggggcatctccattctcattatgttgatttctccttgtgacaaaaaccttttgccaccccgcctgcttcccctcttgtgctctgtcttttctctcctctttctttctgctacctgctcactctgttttctctgtatctctttgttctttctcagagctcttgcctctgacacactttttagtgccatcgttttttgagacagcctgatttgatcactgtcttttctctctccctttgaaagctttctctgttctgtgtatttcctagattactggtgatacttgtcattctggttagattttgttcctgttttgatttcatttttccgtaagatttttgtttggttgattttttttaaccttaagaaaaaaagagatttttttacttgcattccacttttctttctgttctgctctgtaacgtgagtgtgcaatatgctctaaagtccaaaaggatagttaacacagtgggtggtggggctatgcataatttctgccatctttcttatagcattctgttttctgaaattgtttcatggtgcatatgtacacataataagaaagaaaaagcaatgaaacgatttctattttgacaaggaaaaaaatcttaatgagagcctggctttgggtcttgcctctagctctccatgaaacctttttcttatctgtcttcaccaccaagcataaccacaatggctggctgagctggagatggacagcagtctgtggggattgtgtaagtgatccaatggttagctggaacctaccaaactgcaagtcatgggtcacttctgttgattccccaaggctaggctcttactgtcaattgttactaaatggaaaaaaatgcagagaaatagcactgactgccttatgaaatctagtaccctttgttcaatatgacaattagttttgaaagctgctgatgatagcagacaggggtgacatgtgataatgcttattcattatggtagcatcacactgtgattgcagcgtttactttttatctatttattcattcatttatttattttagcattcttattgattgctcttactgattactgcatgctcatttaagttgcatgacaaatgctgttatttgctcactcctcacagaaggcttcgaaaagcaaaccatggcaggtcacccagaaaccaaggtggcagggcactgaataaaatgcagccccccagattttcttccaagtggtgtaatcgtaaacatgggttagctcctttctaaggtggcaggaatcaaagacagaggtaataaactttggccagagaggaggcctgtttttacatgcttgtaaagttgtttttacatgcttgtacaatggagtgtttaaattcacagtccattgtgaacataggcatggtatttcatgactataaactgtcatgttttaagcactttggtctgtcaggctaactaaatataagcccctgtcctaaagaatcaagctcacatagtatgacaaatcagcattttatttatttgtgctaaaagcatttattgaacagctgtgtactaaaaatcctgcaacaagaagtaacattgaaatttccttaaagagcttcttctactgaggaatgtagacatattaacaaataaatacaaagtaggattataaaaaagtattttagaagaggtagctatttacaggatagagtaaagggagaggttaaagttaaaaagttaaattaaactattttttattgtcatatgaacaaaagtatcttcatgttaaattaaatacaattagctgatatttgtatgcatctgctttttatgagctgtcactagaagatgactttttactgcctttttttttctctgttttttttttttttttttttttttgagacagggtttcactctgtcacccaggctggaatgcagtggcaagatcttggctcactgcaacctctgcctcccagattcaagcaattctcctgcctcagcctcttgagtagctgggactacaggcatgcatcacgaggcccagttaatttttgtatttttagcagagacggggtttcaccatgttggccaggctgatctcaaactcttgacctcaggtgatccacccaccttggcctcccaaagtgctgggattatatgcctgagccaccgtgcctggccaccattttatattttgataattcatatttagtactctcagtcacttagttactcaacatctgagtttctttatctataaaattgacttaaacgtctatgtattcaatattcaaaaagtatattggttaggaatattttaaaatatacaacaaagaggtgactatggaatctaaaatcaatttgagaatacatataaagttaaaggtattataattcttattagcttatatgtggggaaaacaaatgattaaatatatgcatgttatgaaagaaaaatttatgaagtaaatatgtagaagctgcaaatggtgagaataatccagtgtctcctttttgagaaataaggaatattctttttcatttgctagagcaaaggttaaagaaagttttaaagacttgatattcctgtatttggatagatcatagataatcattgtcctgaatgctgagtaaacaattgaatacatctaaaaatgtgacatgcattatgctgagaccctggtagtactctctctgaataatgttatttgggcagagctaaaatgacttaactgtaattcccctaaaattaatgtttcttttttctttctgaaaaagtagttttcataggatttagacaatatttcagcataacttcaaaataataataaatttgatgtgttcatggttgcattggtaattagtttcagctgataaatatctgtggctcatagagaatagcaaccaacaacagacctatccccttatgcttcaatcttttctttttttatttttttttttaatgttttatttccataggttattggggaacaggtggtatttggtgacatgagcaagttctttggtggtgatctgtgagcttttggtgcacccatcacccaaacagtacacactgcacccaatttgtagtcttttatccctcactcccttcccaccctttcccccagagttgcttcacccttttctaaaactctttaatatggagtaaaagccaaaatcactttttttcatttttaaaacacctttgaataaaatttgtaatccaatctcttttgtattaaagcattcgaatgcaaaaagtgtaaattttgtctgtgtgtgtcagtttgcaatttcctaaactcacttaagctcaaattgctaataattaaatgagactgagttcgaagatagattaaaggacagctgattgaggatggcagtaattcctaaaggacccaaaagttcatcagaatatcacatttaggaaactgctggtcattaaggtgttaggttgtgaatttgagcctcaatggatgctgctttcttttagaatgaattaccaggtggttattgaggtatactgagtcaggattttttaatttaatgagtgctgtgtaacacttaagaaatcaaggccaacatttttattttttacctgtttgtggtgcatcagccattatttaatacattaaacattggaaataagatcttaaccaaaaatacagattttaaccaaaaacataaatgttggggctttttaaagcatttaatgaatccttagttttgtaccaggtaccgtgccaattatttttcttacattatatcatttaattcttacaataatttttccttcatgaggaaaaatatcctccctccccttacaaggaattgagacatagtgatgctgtcttgaatgctgggtaaataactgaataaagtcacattaagtagagtccaaacttagcttcatttaggataatattcaacacatttggggaatttttttaagttgttcccattttgaaaactgacataactataatgtcatcatcatttttaggaaatgaaccttggcatatcctaggaattttgttttcaatctccaatccaggtggcattctggaaagtggactgttactctgaccagacattcagcctgggtgagctttgctgtacactcagctgacctacttgtttaagggtttttaaaactcctgtgttgacaatagtaagcgtgactcccctctgtgtacctgtgatcaactgaatgtacaatattacaaaataagggcttcttcttggtttctttatgttttttccttaagtcttcacatccttaaaggaaatgtattttataaaattaagtctgaacgagaaagcaaagccccatctaacagaagagatcgtgtccttggaagatgatttcttcatctcagctttctcaggtctctcgagatatttattcatagccctcctatggaaacacagggttctcaatgtgagcagctctgttaggtttcatgtcattgcctctcagcagccctgttcagtaagattttcagtgtctgattgttcttataatcaaatgtgcttttccgatttccaaggtaaatttgctttctaataaatgtaacattcgttggtgcccaatgaagtcttttttttttaacttgtcaaattacttagtacagaaaaatagctataattcttttctttcttttttttttctcttttttttttttttgagacggagtctcgctctgtcatcaggctggagtgcagtgacatgatctcggctcactgcaacctctgcctcccgagttcaagctattctcctgcctcagcctcctgagtagctgggactacaggcacgcaccactacgcccagctaatttttttatttttagtagagtgggtttcaccatgttggccaggacggtctcgatctcttgacctcatgatccacccgcctcagcctcccaaagttctgagattataggcgtgaaccaccgtgcctggccaaaatagctataattctacattaataataatattaatcattttgtttcatttggaacttttttcaattttgcattttctcaatttcttaaggtcgattctaagaatttacttggtaaatcacaggttctcaataagtattttgaaaattaacgtcaaaataaaaagaactgaacactccaggtatagagaagggttcatttaaacttattttctctaagatgatcgatcttctacattttttaaatgaaatgagatgctataaaacaacatattctgactttttttttttttcagtgagacagagtctcgctgtgtcacccaggctggagtgcagtggcgcgatctcggctcactgcaagctccacctcccgggttcgcgccattctcctgcctcagcctcctgagtagctgggactacaggcgcccgccaccgtgcccggctaattttttgtatttttagtagagacggggtttcaccgtggtctcgatctcctgaccttgtgatccacccgcctcggcctcccaaagtgctgggattacaggcgtgagccaccccgcctggcccatattctgactttttaatagattacttaattatatttaattcctagaaacctcttcaacatccttgtatgagattcacatctgtaggttctgcctttcttatataaggtaggataaaatctttttattctttctcttccattcttctctttttatatcttttggcaccttgtgctctaatataagaacactttaagcttctcttcttgcctttatgctcctgaatacgttttcttctacctataattccagttcccatctcacctcctcagtacctctcctctgagccaaatctggtgtttccttgatgctcagaaatggcacctcctccacaaaccctccctgctatgcccatgtctaggcagaatatttccttctttcctcagggctgttacctttctggagtactggacaggatagttattaaaacaaatggttttttagtcaaatggttatttgacctcctgaccagctagaatgtgagctttctgaagagcaaggggcagttttattctttttgtgtctgcaacactatgctcaataaatattaatttggaagtgagaaaagtgatgttatgatgagttaaagttttcatggttcactttttcttctttgaaataaggactcaattgttcattgctgcatacctttcttgaagcctgaagtagatgttgagatgctgtctttgaaaatgtctgaagatttttccatgataatgtggagactctctacctaaactgttgtccaggataagtgatctccaagggagggcatgaaatggcacatatcactggtttccctgtgacagctgcaggaggaacaccctggagtaatggtgcagtggagagtctttgccaaagagttactgtcaaaactgaactaagctgttccaagaggctcttaactctccctaatacgtatggcttaaaataaaacgtggtgtatacaaatgaaaaaaggaagtttgtttaaaaaggtccggggctttgaaaagctatgctttatgttttcaatttaggagtgtataaggcctttggttattgctgcaggttgaagaatgtgctttaacaaaagtataccagctcagaaaccatttctgtcctctcatctacccactttcctttccattcaggtgccactcaacccattttggcaaccaactaaagatacaatagcatacaccctgttaggaaaatctgtagaaaatgtagctacagttttttttatctgggttcatgcagttagtaaacactagttaagcacagactaaatgtaaggtacagtgctgggcagtgaggactgaagggcaaatgagataaggagcttgtcacacaccagactgaacaagtagcaaatacaagagtctacagtagaaaagatggcagaattagttctgactgatcagaagcagcttccacttaccatcagtgtcactttgtacacattaacctctatgtgcctcacttttctctttcataagtagagatgataatactacctcataggattgtagtaaagattaaattagtttatatgttgttataaacgtgtttacgtatgttacatgtagtaaagattaaattattttctatgttcaaacagaccctgacatctagcatgtgcacaagagaatataattatatttcgttttacaaaagatattgtggactttttacaaggcaaatggcaaagagcttcctaggcagaggccaataacctgagtaaagagacgaagcatggaagtatgaagtgtgctgaaggagttcagtgttgctaaaaatttctttaatggaaaagagtggagagatgtcctggaaatagacttaggtgccagatcagaaagggcatatgtgtcagatcaagaatttgtgaccctaatgtttacattttcgaaaagtaagccttgtggcaaaaaatggagttttgtgaaagaatgtagccatggagctcagtgactaactgcttattataacagcccaagttggagatgatggggccagaatggggacatgctgtccatgtcgatgacaacatgaactaggatttgaaagcagagattatgccaagggcaaaatatccactgcaggtgtatcctttcccttttctagaaaatagaactgtattttgtagaatctttttgttcttcatcaaactctgtttttagacttttaccttcaaaccacccaagaacattagagcctcataaactataaatgattaattttatgactcactatttaaagcaaatggaaattttaaacttgtttttatcatgagagtccctgtctggcaataattgggcaaagaaggcaagataaaaaacggatttttcttcaggatctgctaagtagaaacaacaacatagaggctgggcgcagtgactcatgcctgtaatcccagcattttgggaggccaaggtgtgtggatcacctgaggtcaggagttcgagaccagcctggccaacatggcaaaacccagtctctactaaaaatacaaaaattagctgggcatggtggggtgtgcctgtagtcccaaccacttgggaggctgaagcaggagaatcacttgaacttgggaggtggtggttgtggtgagctgagatcatgccactgcactccagcctgggcgacagagtgagactatgtctccaaaaaaaaaaaaaaaaaaaataagagaaagcaacatagatgctgaactttaaggaaatgtgatataatatggacttgctcaacataaactattgaaaaatgtgtgtagttataattattattgtaatgatcataaatatcatttactgggcccttactatatgtcaagcatatattatattacttatgtaacgtgtagtttattacctacattatctcattttgtcatctcaataatcctatgaggcaggtataattattgtcttcattttacaataaggcaagtgaagctcagaaagattatgagacttgcttaagctagcagaggaaggaactataggaaaaaaatgtggtcaaggcagaactccaacccagatctgattttttttcatttttaatttttatggagagatagtagatgtacatatttatggggtacatgagatgttttgattcaggcatgcaatgtaacgtaattacagcatgatgaatagggtatccatcccctcaagcatttattccttgtgttacaaacaatccaattacactcttttagttattttaatatgtataattaaattattgactatagtcaccctttattctatcaaatagtaggtcttattcattatttctaattttttgtacccattaaccattcccacctccccccacccttccaccagatctgattttagagtccacacacttacctgtcctgcactgagagcacccaaaaacattagcagcaaatctggttctttctctggcccagctccctgaggacacatattaaaaggataagcttctttgatgtcagccacaatcttcaaagtcttttaatttctctaaacaatgagtagaaggtctctcatgcaggaatttatcagaggctttgtgagcttatttatgttcatccactgtaataaatactagtgtgcaggtgcatggggcaagtagtgcaactgagtgagaaaagaactcagaaacatatgagaggctgagaccttgaattgtgtgtcctgagtcaggtaaatttatctcagttgcagtttccccttccataaaatgagtttatgtccatttccctttataattcaatgattagtcaactctaaattttgccacctgaagtgtatctacagaaatactccattccagattgattcagtcctctacccaaattgtctcccccatcagttgatgtgtatgtaaggactacacactaattttcacatttccacaagcaaaacacaaaggtaaacctgatgcctcccaagtaatgctgtatctgctatcaccaaacataaatgattttctgattttccactcttttggaatatctgcatcactgttggctttcattagcatgacagttcagaggtgattgtactaaattttactttgtacacatcctagtggcaatgtatttgtgctgtgatataattcatttcatgatttagtgagtcatgatggaaaaaagtattaggtacttctttttctcaatcaaccaagaacacatcctactttttccatctgttcccggcaacagatgtgttatttgacaagaacccactgatttgtaccctgcctggcatattagactcataccactgaacaacaaggtacctggcttagtgggcaccttggcatagtcccttttaggacccctcctttggttttcataaacagaatgttactgccaatcataatatgtattttgtaatggaatttaagattcagagatttgagtagaaacaacttagctattcctcctccatcagactcctgctggatacagccctcattttctcacacgtaggactgataaggaagatcaaaatggtctcctactgtgtttaaaatctttacttttcactctttaaattactggctttctgtaacttccttctgtgttttctgacatctacagtttcacaattattattcttcaagatttgtcttccttgaagtctccatttttgaagtctgggaggagcaccaaacttggttttattccatcacatttagtgatagacttcttcttctgttttttttgttgttgttgttttgttttgttttttaaagacagggtctcactctgtccaagctgtagtgcagttgtggtggatcatagttcacagcagcctcaatctctttagcttaagccacccttctacctaagcctcccaagtagctgggactataggcatgagccactgtgttatctatggataaacttttcaatgagaagatccaagtatcttggccaaaccaaagccaaaggcagacctctaatgaattcaaacagttctagggacagcttaagataaacagtgtgatcctactcggccttaagagtgaggacgctatcggttcattcagcccagagctaggaggagtctgcttcctgtctgcaagatgctattgcagggtccaaggcaggatttctcagaattgttgactggagcagggaacttgtggccctttgtaattcctaagcatcttcctccttttctaccttgccctcatcaagaatcctaaaccaaaaagtatttggctaaagtgtgaaggagactgtgattctgctttcttgaaatttttcaagttcttaaagcacacaatatgaagctctataaaaattatttatgatttcaaaagaaaataattttaaaattaagatattatgatagaaagtagccttctagtcttgccttaggcatgacaaagaactcaagttcccacctgagagagatggtgagaattgtacttcacataaatactgtttactttcactctctaggaaactctataatgggtgccatttggcattctaataactgttagtgcagaaaatagtgtttccaattatgtgttctcaacacacattttcattagagtagttggaagcaaggtttcaggtaactggaattgacctcttacttctcacagaattagaagtcaagaagttggcacctttctacagatcaagttttaatttatgacagacttggtcaactacctggctttactgtgcctacactctgagtttctcctctcccagtgagaaaactgatagccgctggcatggcaggcggtcttccacatttatctttctaaaagtgcaccaaactatagagcctcagagttagattaagggatactagaaaatcctttctcaattttctgaggctggagtaaagacatttttttctgtactctacatgtgttctcaaattctcccagatggctcctataacactggtctagacattcacttaacaattttcactcagtaccaattctggacctgacactgtgctagccacagagtacagtaaacaacaggcaagttcatgaaacactgtaatgaaactggagaactcattttggttttttccttaagaagcaaattaaaacgtgaaaaagaataaatgagaaactaactggccaacttgtaagtagagattagtttttctgatgcttccttaacatcctaagtacctagggatgtcctttacatgtcagacaccattgagtacctagaacagtgtctggactctggtagggagccactgaggtaagcccttctccactttccatagttgcttcttctctggagaaggaaacagaggaacagcttctaacagtgagaagagtaacattaaggaaccctctctgctctcttgtagccagattgcaactgtatgtcctctccttgttagactgagccaggactcccttgcaagggccccaggcttactctgtaccctcccagccatccctggcttggaagattttggtcatcaatctacatttcatatgcaataactttctcatttgtccatttccttaatcaaaggcatataaaaatgccaagcacagctgctgatttgtctgaaataaccagtactgactagaaagttctagtctaaagcaagggaacattatgtttgtggttagtatgtgcaacctcataactggtaaatcaagaatttccattaacatttgtcagtagttttatgactttgtgacaacttcagagactactgagaaccacttacgatgcaacttgggagtgtctctactaagaagacttccctgattcccatgctgggccaagtgtatccaaacactctgtatataacaatcttagtgttcttggaagtgtagtcccagatcagcagtagcagcatctagcatctcctgggtacatgatagatatgcaaatcctcaggtctcaccccaaatctgctaaatcagaaactgggatgcagacctacaatctttatttaaatatgccctcacagtgattctgatgcacactcaagtttgagaacccctgcatcctattaacaaatacatcatgttaaaactattatgtgtatgtgttgaattagaagttgtttgagagcagggaccatgtattcacagtataaatacactgtgtatgggtgtgcattacacaaacagaacgaaacaatatgtactattgtgacatgcttttattttcttccagcaatattttgtgaaaattctttattttgcatgcatatattttgtgatatggtatctgatggctgcgtagtatcttactgtgccagttacatcaaaatttctttgatcttctagtataggacaccataaagctctttttaaaactagcttttattttttatgaaaataatgcatgcatgtacttaaaaatctgttttaagtagcagcccactccacccctcgtcatgtcttattcttacttttagcagcaatcacttcttggtcctttagctgatactatttatgcccatggttctaaatgatatacatatacttctgtgccgtttcaattttagacattatctatgaaattcctgtgatgcagttgggaatttatctctctcatgtctctcaacaccttctttttcagtcttcccaatatagctttatcaaatttttggttaaagcaaaagttcagtgtttataactgtataaatattattccttgtacagccaacaatatgctatggttacatttattttgttgaaaatatttttttcagatgatattgttcttttttctaaataagcttcttttttaaacaacagttttaagttcacagcaaaactgaaaggaaagtacagcattatcccatatacccttatccccacatgcatagcctcccccattatcaacatccattactagagtggtatatttgctacaattgatgaacctatgttgatgcatccttatcacccagcatgcaaagtgtatgtgagcatgtactcttggtggtgtacttcttaaggatctggacaaatgtgtggtcacatgtatcaatattatagcatcataaagagtagtttcattgtcctaaaaagtctctgttctgcctattcagccctccctcctactaacctctggcgaccacggatcttgttactatctccttagctttgccttttccagaatgtcatacagttagttggagtctgatatggtttgactgtgtccccacccaaatctcatcttgaattcccacatgttgtgggagggacccagtgggaggtgattgaatcatggaagcaggtctttcccatgctgttctcatgatagtaaataagtctcatgagatctgatggttttaaaaatgggagtttccctgcccaagctttttctttgcctgctgccatccctgtaagccttgatttgctcctccttgccttccaccatgattgtgaggcctccctagccacgtggaactataagtccattaaaccctttttcctgtataaattacccagtcttgggtatgtctttatcagcaatgtgaaaatgaactaatacagtaaattggtaccagtagagtggggcactgctgaaaagatacctaaaaacgtggaagcaactttggaactgggtaacaggaagaggttggaacagtttggagggctcagaagaagacaggaaaatgtcagaaaatttggaacttcctagagacttgttgaatggctttgactaaaatgctgataagtatatggacaattaaatccaggctgaagtggtctcaaatggagatgaggaacttgttgggaactggactgaaacaaaggtaactcttgttacattttagcaaagagactggtggcattttgcccctgtcctagaaatttgtggaactttgaacttgagggagatgatttagggcatctggcagaagaaatttctaagcagcaaagcattcaagaggtgacttgggtgctgttaaaaacattccatttttaaaagggaaacagcacaacagtttggaaaatttgcagcctgacaatgctgaaaattgtcagaaaatcccattttctgaggagaaattgaagccctgcagaaatttgcataagtaacaaggagctgaatgttaatacccaagacaatgggaaaatgtctccagggcttgtcagaggtcttcacagcagccccacccatcacaggcccagtaccctaggaggaggagatggtttcgtgggccaggcccaggacaccgccccctccccgtgtagcctagggacatggtaccctgtgttccagctgctccagcatggctaaaagggatcaatgtacagcttgggcagttgcttcagagagtggaagccgcaagccttggcagcttccatgtggtgttgagcctgcgggtgcacggaactcaagaattgaggtttgggaacctccgcctagatttcagaggatgtatggaaacacctggatgcccaggcaaaagtttgctgcaggggtggagaacctgtgctagtgtagtgtgaaaggacaatgtggggtcagagcccccacagagagtccttactggggcatcacctagtggagctgtgagaagagcaccaccatcctccagaccccagaatggtagatccacctacagcttgcaccatgtgccttgaaaaaccacagacactcaacgccagccagtgcaagcagagaggaggggggctataccccgcaaagtcacagggtggagctacccaagaccatgggaacccacctcttgcatcagcgtgacctggtagatgtgagacatggagtcaaaggagatcattttggagctttaagatttcactgccctgctggggacttccatggggcctttagcaccttggttttggccaatttctccttttgaatggctgtatttacccattgcctgtaccccctctgtatctaggaagtaactaacttgcttttgattttacaggctcataggcagaagggacttgtcttgtctcacatgagacgttggtctatggacttttgagttaatgctgaaatgagttaagactttgagggactgttgggaaggcatgattagttttgaaatgtgaggacatgagatttgggaggggccagaggtgaaatgatgtggtttggctctgtgtccctacccaaatctcaacttgaattaccacatgttgtgggagggacctggtgggaggtaattgaatcatgggtgcaggtctttccctgtgggagcatggtttcccatgctgttctggtgatagtaaataagtctcacaagacccaatgtttttaaaaaggggagttgccctgcagaagctctctttttgcctgccaccattcatgtaagacttgcttctccttgccttgcaccatggttatgaggcctcaccagccatgtggaactctaagttcattaaaagctttttcctatataaattacccagtcttgggtatgtctttttttgttttatggagtctcactctgttgctcaggttggagtgcagtggtgcaatctcagcaccaaaacctccacctcctgggttcaagggattctcctgcctcagcttcccgtgtagcttgtggcaccatgcttggctaatttttgtatttttagtagagacagggtttcactatgttggccaggctggtctcaaactcctgaccttgtgatctgccttcctcagccacccaaaatgctgggattataggcgtgagccaccacacctggcaggtatgtctttatctgcattgtgaaaatggactaatgcaaacacacatagtatgttaagttttttcagttggcttatttcacttagtaatatgcatttatggtttatccatgtctttttatgccttgatttattgctcatttctttttatcactgagcagtattctattttctgaatatgacagtttatttatccatccacatactgaagggcatcttgtttgcttccatgttttggcaattatgaatgcagctgctacaaacattcatgtgcaaaattttgtgtggacatagttttcaactcatttgggtaaatactaaagaatacaattgtggaagcatgggtagctttgtaagaaaccatcaaactgtctttcaacatagctgtataagtttgcatccctaccagcaatgaatgagagttcctcatgctccacatcctcaccagcatttgatgttgtcagtcttctggatttaagcaattttgttaggtatgccatgatatttcattgttactttaatttgcaatcccctaatgccatatgatatagaacatcttttcatatgcttatttgttatctgtgtatcttaattgggttgttaactttttatcattgagttttaatagttctttatatattttgtgtaacggtcttttgtcagattgccttatttattcatttattttaatcaatttatttgttttgatttcaataggttttgggggaacaggtggtatttggtcacatatataagttcttcagtggtgatatctaagattttggtgcacccatcacccaaacagtgtacactgaacacaatgtgtagtcttttatctctcacctccaattattgattgatgggcatttgggcaggttccatatttttgcaattgtgaattgtgatgttataaacatgcatatgcaagtatctttttcgtataatgacttcttttcctctgggtacatatccagcagtgggattgctggatcaaatggtagttctacttttagttctttaagggatcttcatactgttttctagtggttgtactaatttacattcccaccagcagtgtagaagtgttcccttttcaccatatccatgccaacatctactattttttgatttttttattatggccatttttgcaggagtaaggtggcatcacaaaaccacaatgtggttttgatttgtatttctctgatcattagtgattttttaaaatatgtttgatgtccatttgcatatcttcttttgagaattgtctattcttgtccttagcccactttttgatgagattgcttttttcttgctgacttgagttcctcgtagattctggatattattcctttgtcagatgtatagattgtgaagattttctcccactctacaggttgtctgtttactgattgttactttttctgtgccttttagttcaattaagttgcatctatttatctttgttttgttgcatttactttgggttcttggtcatgaagtctgcctaagccaatgtctagaagggttattccaatgttatcttctagaatttttatggtttcaggtcttagatataaatgcttgagccatcttgagtcgatttttgtaaagtaagagatgaggatccagtttcattcttctacatgtggtttgccaattatcccagcaccatttgttgaatagggggtccttttcccacttcatttttgtttgctttgtcaaagatcagttggatgtaagtatttggctttatttctgggttctacattctgtccattggtctatatgcctatctttataccagtaacatgctgttttggtgactatggccttatagtatagtttgaagtcaggtaatgtgatgtcttcagatttgttctttttgcttagtcttgctttggctatgaaaggctccttttgggttccacatgaattttaggattgttttttctagttctgtgaagaacgatggttgtattttttgggaattgcattgaatttgcagattgcttttagcggtatggtcattttcacaatattgattctacccatctgtattagtccattctcatgctgctaagaaagacatacctgagactgggtaatttagaaaggaaagaggtttaatggattcacagtttcacatggctggcaaggcctctcaatcatggtggtaggtgaaggaagagcaaaggcatgtcttacatggcagcagataaaagagtgtgtgcaagggaactgcccttataaaaccatcatttctcatgagacttactcactaacacaagaacagcatgggagaaacctgcccctgtgattcagttacctcccactgggtgtctcccaggacacatggggattatgggcactataattcaagataagttttgggtgggggcacatccaaatcatatcaccatccatcagcatggaatgtgtttccatttgtttgtgtcacctataatttttttcagcaatgttttgtagttttctttgcacagttctttcacctccttggttaggtatattcctaagtttatttatttatttgaagctattgtaaaaagggttgagttcttgatttgattctcagcttagtcactgtttgtgtatagcagacctactgatttgtgtacattaattttgcatcctgaagctttgctgaattcatttaccagttgcaggagctttttggataagtctttagcattttctaggtatacaattatatcatcagcaaacagtgacagtttgacttcctctttgccaatttggatgccctttaattctttctcttatctgattgccctggctatgacttccagtactatgttgaatagaagtggtaagactggacatccttgtcttgttacacttttcaagggaaatgctttcaacttctccttgttaagtattgtgttggctgtgggtttgtcatagatggtgatatggtttggctgtgtccccactcagatctcatcttgaatttccaagtgttgtgggagggacatgatgggaggtaattgaatcatgggggcaggtcttttacatgctggtctcatgatagtgaataagtctcacaagatctaatggctttataaggtggagtttccctgcacaagctctctctttgactgctgccatccacgtaagatgtgacttgctcctccttgccttctgccatgattgtgaggcctccccagtcatgcaaaactgtaagttcattaaattctttttccagtataaattacccagtctcaggtatgtctttatcagcagtgtgaaaacaaacaaatacagatggcttttattgcattaagttatgtcccttctacgctgattttgctgagggttttaattataaaaggatagtgaattttgtgaaatgctttttctgcatctatggagatgatcatgtgatttttgtttttaattctgtttttgtggtgtattacatttactaacttgtggatgttaaactatccctgcatccctggtatggaacccacttgatcatggtggattatctttttgatacactgttggattcagttagctagtgttttgttatggatatttgcacctatgttcatcagagatattggtctgtggttttcttttttttgttatgtcatttcctggttttggtattagggtgatactggcttcatagaatgacttagggaggattctctctttctctatcttatggcatagtgtcagtaggattggtaccaatttttctttgaatgtctgatagaattcagctgtgaatccatctggtcctggactctattttgttgacaattgtttgattaccatttcagtcttgctgcctgttattcgttcattcagagtttctatttcttcctgctttaatctagaaggcttgtatctttccaggaatttatccatctcctctaggttttctagtttatgcgcatagaaatgttcatggtagccttgaattatctttcatatttctctgttgtcagttttgatatcttccattccatttctaattgaacttatttggattttctgtcttcttttcttggttaatcttgctagtggtctatcaattttatttatcttttcaaataaccaggttttgtctcatttatcttttgtattttttttgtttcaatttcatttagttctgtttggatcttggttatttcctttcttctgctgggtttgggtttggtttgttcttgtttctctagttccttgaggtgtgaccttatattgtctgtttgtgctctttcagactttttgatgtaagcatttagggctatgaactttcctcttggcaccgcctttgctgtatcccagaggttttgataggttttggcactattatcattcaattcaatgaatttttaaatttccatcttgatttcattgttgacccaaaaatcatttgggagcaggttatttaattccaatgtatttgcgtggttctgagggttccttttcgagttgatttccagttttattccactgtgatctgagagagtgcttgatataatttcaattttcttaaatttattgaaacttgttttgtggcctgtcatatggtctatcttggagaatgttccatgtgctgataaatagaatgtatattctgtagttcttgggtagaatgttctgtaaatatctgttaagttcatttgttctagggtgtagtttaaatccattgtttctttgttcattttccatcttgatgacctgtctagtgctgtcagtggagtattgaaatcccccactattattgtgttgctgtctatctcatttcttaggtctagaagtaactgttttataaatttaggagctccagtgtcagatgcatatattcttgggattgtgatatttttctgttggacaagtcattttatcattatatgatgcctctctgtgtattttttaactgctgttgctttaatgtttgttttgtctgatgtaagagtagctgttcctgcttgcttttggtgttcatttgtttggaatatctttttccacccctttaccttaagtttagaagagtccttatgtgtcaggtgagtctcttgaagacagcagatacttggttagtgaattcttatccattctgccactctttaccttttatgtggaacatttaggccatttatagtcaatgttagtattgtgatatgaggtactattctattattcctgttatttgttgtctgaaaatttggtgttttttaaattgaggttttgttttataggtcctatgagatttgtactttaaggaggttctattttggtgtgttttgaggatttgtttcaagatttggagctacctctagcagttcttatagtgctagcttggtagtacaaattctctcagcatttctttgtctgaaaaagactatatctttccttcatttatgaagcttagtttcccaggatgcaaaattcttggctgatagttgttttgtttaaggagactgaaaatagggcccaaatcccttctagcttgtaaggattctgttgagaaatctgttgttaatctgataggttttcctttataggttacctggtgcttttgcctcatggcttttaagattctttcctttcatcttgactttagataccctgatgactatgtgcctagacaatgatctttttgcaataaatttctcaggtcttcttttaaactggcctttttaaatgaattgtgctagtcttcagtgagcagtttgaatatggagtctctaattcatttttaagttcttgaaagttttcttgaattatttacttgataattttctcctatgtattttttttttcagttctgtttctgtaactactgttagttttgtattacataggaatttattctctagatttcatttttacaaacattcatctcattgtccttttattccactttctgggagatttacttaaatatatcttccaattatttgactttttaatactcatctgttaatttttttattttcaacactacttttgcattttcagattgtttctttttcataacaacctgttcttattttatggctacaatatcttttattatttacatctatcattattttctgttttctgcatatattatgcatgcattttttttctatttccttgttttctgtttcttttgacatttgactttcattttggaagtttccctcaatttatgatcatcttctgctgctgattcatatttaagaataaagcaaaaaataaagacagattttgaaatgtgtttgagtggaaggttttatgttcactgtagcttggtcttgctgagccagcccttttggaggatacctgatttagtgtatataggtttttctctagagagacattgaattttttcagaaaacacctcatactcttgcttgggaacataacccttgcttccaggaggctgaggatctcaccattctgtgtatggatttggggctttcagctacaagttgaaaaccaattctccattgtgtccgttgctctctttatttcaagtactgagggaaaaaattttttgccttctctctgggagaggactacagttgcatgcctattctctaggtattgactttcaaccagtactctgttcctcttttaccccagcattttgttgtgctttttaagatatcctggactcttagtctgacttactacctctataaatgaaaattgcttgaattttcagagcctctttacccttatctgtagaatgtccaccttaggaattgaaagaattatttatgtaaaaatactttatggctggatgtggtggttcacacctataatccaagcactttgggaggctgaggcaggcagatcacttgaggtcaggagtttgagaccagcctggccaacatggcaaagcccgactctaccaaaaatacagaagttattctgcacctgtagtcccagctactccagaggctgaggcaggagaattgcttgaacccacgaggttgtggttgcagtgagtcaagatcatgacactgcactccagactgggcgacagagtgaaactctgtcccaaaaagaaaaacaaaaacaaaaacaaaaactttgtgaagtaactgtaaaccacagtacaattcagctatatgactgtgacttctttctatgccattagatgagaaactcatatatgacagctacactgctacagatttatatggtctcttttttcgtttttcttttctttctttcttatttatttatttttttgagtcggagtctcattctgttgcccaagttggagtgcagtggtgcaatctcggctcattgtggcctccgcctcctgggttcaagcaattctgcctcagtgtcctgagtagctaggataagaagcatgtttcaccacatctggctaatagatatttcttttaagttttatataatcttaaaagttcaggcaaatcaataaatgtaatccagcatatatacagaaccaaagaaaaaaaccacatgattatctcaatagatgcagaaaaggcctttgacaaaatttaacaacccttcatgctaaaaactctcaataaattaggtattgatgagacgtatctcaaaataataagagctatctgtgacaaacccacagccaatatcatactgaatgggcaaaaactggaagcattccctttgaaaactggcacaagacagggatgccctctctcaccactcctattcaacatagtgttggatgttctggccagggcaattaggcaggagaaggaaataaagagtattcaattaggaaaagaggaagtcaaattgtccctgtttgcagacaacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatccaacttacaagggatgtgaaggacctcttcaaggagaactacaaaccactgctcaaggaaataaaagaggatacaaacaaatggaagaacattccatgctcatggataggaagaatcaatatcgtgaaaatggccatactgcccaaggtaatttacagattcaatgccatccccatcaagctaccaatgactttcttcacggaactggaaaaaactactttaaaattcatatggaaccaaaaaggagcccgcatcgccaagtcaatcctaagccaaaagaacaaagctggaggcatcacactacctgacttcaaactatactacaaggctatactatactacaagtaaccaactatactacaagtaaccaaaacagcatggtactggtaccaaaacagagatatagatcaatggaacacaacagagccctcagaaataatgccgcatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagctggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaaaaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagatatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatcgtggaagtcagtgtggcgattcctcagggatctagaactagaaataccatttgacccagccatcccattactgggtatatacccaaaggactataaatcatgctgctgtaaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaatcatcattctcagtaaactattgcaagaacaaaaaaccaaacaccacatattctcactcataggtgggaattgaacaatgagaacacatggacacaggaaggggaacatcacactctggggactgttgtggggtggggggagggggagggatagcattgggagatatacctaatgccagatgatgagttagtgagtgcagcgcaccaacacggcacatgtgtacatatgtaactaacctgcacattgtgcacatgtaccctaaaacttaaagtataacaataataaatttaaaaaaaaaagaaaaaaggaaaaataatcttgtaaaaaaaaaagttcacatgaatcttgcatcttgctccataatttatctgttttaatgtaaaaataatgttcttcaatcttttatcatggagccaaactgacaattcaggaagatatgtgtattccttttgggatttatgtgcctcccagcatattgggagatatccttagcagtttatgtacccctgtttaagttttatagaaataatctctaagccattagttctgataaatttggttccttccaatcctttgtttctaaactttgattcaggatgatctgacaaattaaatagcacccttaaacaataaggcatcatggcccagtatacagagaaatatggagatagaatagaattggcatggtgtctcacgcctgtaatcccagcactttgggaggccaaggcaggcggatcatgaggtcaggagatcaagaccatcctggctaacacagtgaaaccccatctctactaaaaatacaaaaaattagccacgcgtggtggcgggcacctgtagtcccagctactcgggaggctgaggtaggagaatggcatgaatccaggaggcagagcttgcagtgagtggagattgctccactgcactccagcctgggcgacagagcaagactccatctcaaaaaaaaaaaaaaagaatagaattgactatgggctgttgagggagtagcttattacaaatgtgtaaacctacttgtgccttgttgttgtacagaacagtgaaaattgccaggggagtggagaagaaaattagcagtgtctgcctattctggatatttcacatcaatggaatcatacaataagtggactttgagtctagattctttcacttagcatgcatgatttttcaaagtttgtgttttagcaaatatcagtacttcattcatttttatgactgaataatattccattgtatggatataactcattttgtttattcaatcatcagttgatagatgtttgatgatttctcttttggctactgtgagtagcgttgttatgcatattcttgtacaggtgtttacttgaatacctgttttcagttcttttgggaatacttaggagtagaattgatggatacagtaagtctatgtttaatttattgaagatctgtcaaattgctttctacagtgattgaatcattttatattcctactagcaacgttgaaggttcaaatttcttcacattcttgccaacccttgttatttttcatttttttaaatagccatactaatcagtgagaggtagaatctcattgtggtttttgttttcattttcctaatgactaatgacattgagcattttttcaagcgcttgttgaccatttatatatctttagagatatgtcaagtcttttgcccatttttaaattgggtcgtttgtctttgtgccgtggtgtttcaagcataaatctatagacaaaataaaagctacttgttggctgttttattggaaatcacacaacttgggaaagtctcaaggataaattttgctaaattctttgtccactattcactaagagggtcccttaccctttcttttcctttgatcattggttatctggtttcacctgtcaagaaataagctgccctttgattgtggataataggtgagacaccgcagaatcaagttacactgttgcatctgtaaagtttcatcactgtgtgtttccaggagtcaggatttgccatcaaagtcaattgccgaatgactctgactttattattctttatttgcattaacaattgctctaagcagtaacacgattataacccaaaacagcagcctgttatctatcatttatttgatttaatacatagaaatggatgtctttcaaagagcatttatttttttcttcacattctcttccaaaatcattctcagtggaaacatttagccttataacatggaggaattcctttgtaaatccagtgactatgtgggagactaagaatttctgattttattaagtattttggataaatgggtaaagagaggaatggtggcagattttacaatggttggtttaggcttctgtaggccttgagtaaggtgagtaggagtaatgcctgtggtcatttcatttgaatggcctatttattgaagtaaattcatagttcaaaaagatccaacttagaaaagcctgaggcagaaatggaatcctgggagtgcagattggtcattgttttatttaatctgattccactttattctcctcacggtgaaattgttctttatgatactctgtatctactggtagttcacatccttcacagaatcctctaactatgcaaaacacatagtgaacagttatcatttgaatcttagtacaactttaataagctgtgttttatatttaagtagtttctcccctggtggttgcccgtggcagactttggagtttgatagctcttcactccctattttatacatctctaagtaattataccctgtgcccttaagcctcaaaagcataaaattatttaaaaacatacaattaaacacttcagatgacagtgttaaaacttcagaagaagacactcactttggaagaatggtgcttcgtgctggagcctttatatcagctccttcttctccagagactttgggctgaagtttctgtctcagcatgggcatctgccatgcttgttacaggctcaggatgacccagcctcaaaattctattaacttgggataccattttgcaagggaattcttgtcatcagctttgagggaggggaagcataatgatatacctgatgttgacagtaagtgttgtagtggcagtgaccacgtgttatactcctgatggtatgctaggctccctaggtacattgttttacttaatcctattgaaaccccacaaggtgattgttattaccctctcattttacagatggaaagactggggcttaagtagttgtttggttagtgagacagtaaaaagcagaataaggatccagacttaggtaaactgaccacagttctgaaaaagcaagctgggcagggtcttgatggtgcatagcatgtcttcagcatggtctcctctgggcagtgtgtctgactttcctagtcagcctgaccacatggcctcctgtttccttggcaccctgtacgtgcttcttctgcagctgttgtcatcgatatggcaactccctccaaacctgtccccatccccccagcctgtaaacttcttgagagcaatgatgctgtgttgtttacctctgtatcttcaagactcaacacagaacaggagttcaaagtttgtggaatgaatagtggaattaatggtaaaaaaaaaaaatgtgtacatacgtgaattaataggttgtttcctgctctctcccccaactcttaatataaaatgggcccagccattttcataagtccctgggtaaatcattccattatttttccctttactttgttcagtccccataattccttttttagactgccttgtgcattcttattttctacagttggcacttatctgtgatccaagccacatacagccttttaaaagtgtgagatcttacccattagtaggtcttgaaattaattttgagggtggcagccagcattttttttttaaatgaagagactagaaaagaatacaacttctcagcatgcatggcacatagaaagacacagtatttgtttcagatggatagataaatagaggacatatatgtatcactagcacttgtttgaccacaagtcacacactaggacatcatttaagacagtgaaagacatttaggcacatagacacagtatttgtttaagatggatagatagagaacatgtaagtatcactagcactgattaaatatcatacgtgcagccatgttttaagaaggccaaatgctgcagggatgctcattaggggagtgtattgcaacaaccactatccacattttaaaaaattgtacattgtgaccaattacatatctgctgtgtaccagattgtactctgaagtatattccttattgttggaaaaacactgtcctaaatgacgtcccagtgtgtgacttgtggtcaaacaccccttgctctgctaaagtagttcctaaagtcttatattttgtaaaagctattataaaactgtcaccaaagtttagaaaatttaatcccagtgcaattattttaatgatgttaaagtataaatgctgcagagaatttaataggaaaaacacatagaaagttctaaaaattttaatagtgggagcttaactttgaggtttgcagaattattttattttgtactcgtctttaaatttgcttctccaaatgttcacctaaaagtcccgctgctttaggtaaattgcgggggctacatttatatcagtcagtggcattcatgtaggatttcaacttcaacttgctgtgaaggagccagactttgctgtggaatgcattcatgtgcagagctgccttgcacagctcattggagataagacagttttgacttcacatgccaaacttttgtcactttgtctattttcgtatttctctatgactctgcagagccaagcttttgatcggttgagcagcaaattgaaaatgctcttcttaaaaaatctaatactaaagtgaataccaagcaatactgcatttcctgaaatgaatatttgttgagtgcttactctgagctagccaattgttgtaccctggggttataaaaaatgaatgagattcactttctgctctgaagagtcttctggtcgaggagctttcctaccgcagggtttggattcatcttgcttgggtctacgggtagactgaagatccttcgtttgccctcccaactcattctgggcctttccccacctttgacctgtgaggctggtcaatatgggctgcaatcgagggctcccttgctgtctggcatctggttaggtttaaccagggggagcactagcaggaactagagggaaggagaatggagaggttagcatatgtgttctcccggctccctccttgcaaggtcacccaggttggctctgtctctctactaaaagtcacagcttcattcaggtgtcctctccacactgttctttctgtttccatgttctagtgactgctccctcccctagcttgccctcctttcccctatagggtactgtgccatcccttgtggttttgctataccctcaccacaaactcctaaatcacccttttgacactgacttagtacctcactgaacacgactttactctgaactttttcctttaggtcctttcagtgctcttgacttatgccttagctaattttctgccatgatttcaaaagacttacgtatttgtacgtttccaggaagccatcttattaatcaatatggaaagttatttaaaaccacaacctctggttcttacaaatatgtgttagctctatgaaattgatacttggaaagctcaataactatttataactgtgggtgatgttgatcatgacccatcaataggtcagagccttcattgttaattacctagttcactaggctttgttacaggctggatggaggtaggtatcccgggaggaatagtcttacagaatagtaggagaacttaccactttgctgacaagttgaccaccagtccccactttgtgagtcctattttaagtgttgccatctgttctcagaaaagaattaaaaaggatgagataatcatttaagcccctggcaacagcaatagctgagtaagtggtcatttattcattgcctctgtatatcaggcattctacttcacaagcatcctactagaatctttaaattatcattatatttaacaattacaattaccctacgaggtcattcttaattccactttatagacagagaagctgggagtaaaagaatgtaggtgactttcccagggaagcacagctggttatttccagagctatgatttgaacccagctccatcaaactcagaagtattcctcccactatttcatctccccaaatctctttctttttgccttcaatgttgccaaaagtcatgtttggcatcaggtttaagattattaaaacttcaaactttcttttttcaaaatcaggcgttctataaattaaaaacaaaatctgattgggattcatctccttctcttccaatagaaacagagtagagggcatggaatttgagggaaaaggaggaagaataaatgaacagcatatgagcaaaggacctggggaacccccaagtgactaacaatcaaaaatagaattttctgcatgtcagatattgagtcattcgctgcatggcccaattaacctttcttctgattccagattttgaacttgtgtccttggagaacaaaatgcttacccattgccttggctgagtcacttctgtgcagttttagatgaaccctgcttgcacattattccattggaaacaagcattttcacagtaggttaaggactgggactaaaagaaaagagaaagctaagatgtccatctgaaaactgtcagtgtcgtctcaatggaaagttatgatgttttacttctctgaaaaagctaaagaaagcaatctggccagttataaatttaatttatgaaaataataccacaggcctaaatcatccaacactatagctattgattcttctttctagttccttggggaacagttgctgtatttgagaaggtagaactacaattgtcttactttgtcatttaaatgtcatattagccaaacactgagcacagctgaagggttgcaaactgactaggaaagaatgggatagtatttttcattttttttttaaatgtaattggtagacagattttcctgttggtgagggctgattttttttcctcattatttctctctccttttattttctccacaatgttgcattttcttggttttctgtgaggcattaggaaaggataaatcatgacgttctgggtctatggtcttttttaatctctcagattattttctttaacagaattgttggaaagttggctgttacctgacagaaaataaaacaaccaatttttcatcgcaagttaaataaacattgaaaaatcagcattctacaaggaccattagcttatgtatcactgtaaaatgttttatgactcttggtataaaggatgctcatataaaaataaattgtgtcataacaaacatttctcccagtcatggtttgtaatagccttaatctcaaataaatctaggttgaacattgtagtctccagaaaaactgaccttcagtttcaaatagttgggttaaatcattgtgatgatgacatagtctcagatataaggagatatgaacttgtatcagctccccagataatcttttatttagaagaggagagatgtctcaatgaactgaaattgctcttgagtgaaccattttatttatatatcttcttattctgactaccagttcacacacagtgccacagagaatcctgcacatagctccctagggttcctgagagagcaatccatggaaatacatagattaaaaaccatgagcaattgccattttacatctgtcaaattagaaagcatttttaaagtgcaatactgctgctacaatgttggtgaagtgactggactcatatactactggtagcaatataattgctttggaaagtattttggcaatacatcaagtgttaatatactttgatactacaattacacttctgagaattttgtgtaaggagtaatttagaagaattcagaaggctaagatgttcactgcagaattttttatactagtgaacagttagaaacaactacgtgctcaacaatggagactcttagtcaattttaaaagtctgtaatgggttatttgcatgaagtctaattggcaacgtttaaaattttgtgatatagagctcagtaaaaagtactaattataagcatataaaattattgcatatagataagaagcagacttcgctaaaattgttcagatttagctgttaaatgatattttagctttataatttttgtattaaacaataagatctaaaaactacttgactgtgaagattaatattaatgaaaagatgtttttattcgcactttccttaagatgttttagttgttcaagtatgaatctttgagacctgaaagtgtcaaggattcggagaattggcatttatatgatctaatttacaaaaaaagaaaagaaaccaaataaatgaacaaaagagagagacattcttccagaataatgaaacctcccattcttgttcttttggggatttttaatgttggcacttggagtaagaagatctcatcagataatttagagagaagtcattcctttaacatgatgaagcagtgtagcttgtggccatgaaccgtgaaatgtcctgatatgagtggcgtaagtaggctttttggaaggggctctatcccaaagagccataggacagaagaaaatgtgaatataggtgatccatccctgctatgcttgaatcagatctataaacattgcatagggaaaaaagaaaacttttggaaataacctaaatgcccaacaactggggattagttaaataaagcatggtatagtcagatgatgaattattaagtaggcattgagagtaaagtagaaaaatattaatattaatattaatctgattaagtgtctgcagtaaagttatgtgaaaaagggagataaaaattatgtatacaatattaaaaagttgtaaacttatcaatagtggttatctggatgttggaataatagacaattaattctctattcctgtccatattcttcaattttttttctcctatactgtgcattactaaaataattaggaaaaattttttgcaattattttttcttaaactgtatgggtacccaaatacataatgaatgagctattgcctgaaataatttaaaaagtggcagcatataaattgcaataaaatgaaatacaattttcactgtataaatggaatgaaagtctaaagcagtactcaggtaaggacatttcgttttaatgtaacgccagtgaggagcttgcatttaagtgccaaatattggtatttatgtatatgaaagctcttctttactctcttatattttctttttttctaaaattttttttttgctaaaattagggtgtcatatataccagaatcaatcaattcttccttctctccttcttttctttctttcttccatccccctacctttcaattctgcaaagataggcaagtgagtgagggtgggtctagcttagtgtttgcccatatgtaaaatgttttgagttcataaaatcctgaaaaaattaaagcagcagacagaaaacagaaaagacccccacttagatactgattagcaaatagacacaaacatttcctctaaatacttcagtgcctgtgatttaagtagctacttgggacacattgaagagtctgttgttagctttctgcattcacatgataagaaacaaagaattctttaggcttgacctttgcaaatagaaaatcctgaaaacgagaatgctgtaatttttctttgtgaagctcaaacatatattgaaagagattggcctcgaatctgtcaccttctcatcactaaatatggcagccctgaagttaattaaataatgcaaatgctcaaggcggccttcactcactcctttcgatgcactgataaatggaggattttagttaggggtttgttcttgttcttactcatttttttaccaaaagattttgtctttgcttgtaatacttgaggatctacactcccattatctcaattgaggctaagggactaagggattccctgtccagtgtgtgatgggccagtgtaatcattataagtgatttcaaatcaatataatttggcaatagcaaaaactatgagaatttctcctcaactttttattggttttaggtaaatacttatgaagtagaggaaagaaggtaggacatgtgaatggaaggaaggagggaaagagaaaaatactctgaagtcatgcaggaaaaaataatttctttccttggccactgaacctgttgatgtggactcatttgttttttctcccttggtggtttaaaagagaaagcctcaccaaagggtaatcaattgattattataatattattagctggattaaaataatgttatttgtgcagaaaacaattcttgcatatgtttattttaaattcctctgattatgtgttgtaatggcttagcctaggagttagccaaaaatgatgtttttctaacacaagactgttgttgaaagacttctttttccctaattatttattgtgatcctaacacaacacacaccctcctgtttcctccttcatgccatcatcatttacatttttgttacctccttgtggatttgagggacgatatctaatagtacagaacatagcattgctccaggacctagcacaatgtcttgcctagtgtaggtgtttagtaaatattgaatgaattaaattcagaaccctgagggagaaaagtcacaaatttatcaagtaattcacaaagagacatatccctgacagctaatccagttaaaagtattaaggtaagctgaaaccagaatatgtttcaaatcatttctcttcttataagagttttgttactggctggaacagttgtttcttggtatgctgatcgaatgtgacttgagccagaaagattcacaatgaataacaccaggaggcttatgaatgatgtataaagccaaccagtctaatgacaggtaaggcagaggtgagcagttactttatttcagagcagccaaagtcttggcaatgtaatgcaaccacgggaatagtgagtggttgtgaccagtttgtagtaaacttctagaatgaaacaagctttaaatgttctgatggatatttgatcttttgtattaatggagccattgcttcagatgagcacaaatgaaaatggcccctcttgctcctctagtatttgcccaggggttacaaggatcagctaagtgctatggagggtattaatcactttttacttgcagtgaaactatatttgttttttggtaactagcaattctaatacagtaaaacttcaactactaaataaatatcattagtattatgactttaattgaagaccaaggtgtcaccatcttgaagaaaatggtgaaagtttactttctgttccctattgatacaccagggccaacactgatgacctgttaacaataatgatataatttttttttaatttttcctgaattttctttctaaaatctaggttcggcaacagaataatcaaaggatttattgctttgccattctgtgcctagcactgtgaatctctgtaactgacttgatagaaacatagatcataatatttttgggtggaaatgaatcacagcttatggttgcaaaagattccacatgaagctaatggattgtagacatctgggaatgggaaatgatatggtagactggctagctgaagactgggatctactcccactgcatgtgtttctgtatataaaaccaattgctcatgcttctgtttattcattaaatgaaactcttattttatcaggtgggttccttttcagtggcaagttaaaataaattagaagaactagaaagtgatgtcacaaacatgaaatacattttctcctgtgttgtctccctgttgaaaaaaccttttcaaacagatttttccctcatggttccccaaatccaataggggggaaaaatccagggtttcttttcccctggagtttggataaaaactcaaggcttgatctctttagtccaaatgaggtcacctgtccattccaagaggccatcactgaggccaagagaatacctgggtcacagttctctactggaagtgggattagctccacataaactgggttgagcacagggcgggaattcttatgctgaggtgattttaccagaagtagaaattggatgttgtaggcacatgacagatattcactgtgcttactggtagccaggtcctttacagattgttgatacaaagacaaacatgacttgatctctttccctctctgaatctcaccacctgatctttgttaataataccctgtggtcaatttttcttacgtcatatttctaatattgtcctacccttcttcaaaaatgtttctggttctttatcatctattgattaaaatattaactccttggttaactttcttcaatctacctctcaatcctggcaaaagtgactgattacatatccttggattttcctgcctctgtgagtgtcctggaatgtcttcctccatgctaatcactgaccatctgaataccgttaaggtgtagttcagatactgtcttcataaaacacccactgatttccttcatctactgtctatagcacttaacatgaacctatcttaaagcacttactgtttgtttaacaagtagtgccaaatgcttactatgttcttattgtttttctgagtgcttaaaaatatgtttttctactttgtatcagtgttcttggtgctcttgtcttttattcccagtaagcgataagctcagtgaagccgggattcttaaaggcaatgagttacctacccatagtgggcaaacaacatatttatactggataaatacatgttaatccaatttgcacatttattgagcactagcacttcaaacctaagagagtagggccctattttctttcaaatctctctctgcacatagtatggtgacatatatgtgttaggcattcaataaacatttgctaggcctctaaatgtgatggaaatttcaaatatccagatatctaagaatgagccatttccttttgttttacattcttcagtctttaggcatcatttttgaaacctcttgtcattttgctcttcctaacagtttttacaagaatgtctaagttctactttctaagttgagcaggatttgggtccccttttttttttttaacaacagggacattttcagcaattgcaaatgcctatgctattgagccattgctaaaatactgggttttataaagtgcttctaagggccaaagagctttgctggcccatggtctgtgcaggtgttcatgagttaaagcattcaatggccctagcaaacatgacatttaaggaggtaagcattgatttgtagagtcactttcaagtacaatagaacatcttgccttcatttgtgagtttcttgtttgaaatggccgacattttaggtgtttccatgtagaaattttgtctaaaatatgtaaagcataaatgggtaaaagaaaagattcatttacttgatctcatccatgctggacaaggacaaggcttccatgttgtctttctattctgaacaagagattggaagcctttctctctcttttttcttttctgttcttttcttttcagttttcctcttttgtcgtttctcttcatgaataacttttcaaccaagttagatgaatgccaatagctgtcaattgccactgacaactagaatggccttggtgatctgtgtgagaacaattttagggaagtggtgaaggcagaagccagatgacagtggatgaacagttgactcagtagtctggtgagtgagatgtgagctccggaaagggaccacccaagctaaaacccagactctgctactcactagctgctgacaataggcatgttaccaaagcgctcactctccctgcctcaatcttttcctctataaaatgggaataaaaatagaactatctcaaggttgttatgagtagtaaatgagttcacgtggataagatgcttagaacaatgccagtttcattataagtactcggtaaaaattagctgttgtttttggtgcacgtgcgaagacagcaagttgagactacttttgaagcttaattatgaaaattggagagaaaaacgaggccagaggtagatacaggccaggaattaggtgaaaggtgattattttatattctgggggaaaagaagtggctctcggagagtgacagattacaaatgggggaagaaggattaattgatggagtaatagtgctgaaaggcgagtgaggatggaattcagagaagaggtgaatagatggatggataaatcttggatagaaggggcttcttgttctctaaggctgaggctaaagtggaggtaataaggaggaaaggctaagaatgcatgtctttgtgggtggggagtagagagttgaaaggattgaaccctaacagcttactgtctctgtgaaatagaaacaagctcatctgatgggagacaagaggtttcagagtgaggaatagagtagaactcataaatgaaggagaagtcacacagcagtaactcctagagacccgatgacactagccagaatgtatagtctaaccaaaggattgagaagtcaggtatgataagaaattgtgctcacacagtgagacactggcatttgcttccacaggtgggacatttctaggtggtgacaaatctgagatgaaccatttgaaaatttttgtggtctgcagtgtacagcttgaacttaaaaaatatttttaccacaaataaatgattgattatattcatacctttcttgagttattaaattatcttctgtttcctatacatttgcagtgctattgggatggtagactttcagagttgaattatatcctgcctctattccacctaatgcatccttgagaatagttatagatgggaaagtcacattttattgtgcttatcatgttattctttagtagacattccattaatgtagaaacatacatggtgtgatacggattttatcttgtgatgatcagatgaaaagccctcctttcctgcatactcttttgcaatgttatttcatcactcttcccatcaagaggtggagtctacatttcctcctattgaatctgagccaggcttggaattagtttaaccaggataaggcaaaagtagcacagtgtgacttctgtgcctaaaccttaagatacattgcacttttcatttttgccatgttagaatcctgagctaacaagaaaaaaaaaagctttaatttccctggcctgccagagagaaaggccaggtagacagagacccaggggatgaaaaaccatagaaagagatagggtgagacagtgagacagcatcaacgagttcaatcaccccaacagagacattggacatgttagtaggaccagcttgcctcagtcaacacatgtggcacagagacaaaccattgccatagagcctccccacaatgcagaattgtgagcaaaaacatggggactgtcactttaagcagaatagttttgagagctttattatgctgcaatagggcatgaaaagaaagagcctcaaagcagagagacaaattacaagaccactggcataatccagatgtcaggcaatgagctggaaagtatagagagaaaggtagaggaaaatgtgggagagcagtaggtggcaaggttcagcgggacctcatgattggatctgggacaaaggagaaagagaaataaagattactatgacactctgtttctaggaaaataagattgtgaacagcaatatggtctagataaagaactggattttgggggaagataagtccaattggcagttgttatttcttgatgtgataccacaacttctatgtaaaacactcctaagcagctggagatacagaccagaagcaaaggatggagtcaggtgattagaatagctattaactgtttttgtttcaaacaaaaagatgcagtcagctctacttccctgttgttccagcctaaagggtgttttctaatttccttctaactcctatattgagtaggaaaggtagagatgtcaagagaaggcggaagagagaaagagaggagagggagaggactcttgtgaagagaaaaagccaactcgcatcctgtgggattgcaccttattttagttgcacctcttggaagcttcactgcttatgtaaaaataagaaaagcaacatacacgctcaactaaaattatcgtcattcaagagtcctccctttaaatagcaccaaatgaaaataagaaaccctaacctcagctttttaaatcacaatggaaggataagagatgctttccatttatgggatcttagaaccttcaaaatggtgctacttttgttccgtgtgtgcatagggaggaagctgggaatgctgaggtggcgaggtttcacctggcagtcaggattgctacttcccactcaccaagttgtgcaatatttgcaagaagagcaaaaaataaaagatagtgtctctttaaaagggagacagtgtagtttaaagaggctacagtgtagtgtagcggcttacgctctgtggtcagcaagaactgagtttaggtccttgtcccatcacttactaactgtgagaccctggatacaatatcaactcctaaaaacctcagtcacttcagctgtaaaatagggagaatgctgtatactggggttgttttgaagagtaaagcagaatatgtatgaaaagcacttagtctggtaagggcacaagttactaagtggtaactatagtcattggaattagtaatttgggactttcacatatttggcttatcattgagactattttccaggaatgtttacaataagaaacttgggccaactgcattttagtcaaggattaaaatgtaacaaatgtgtaatattatattatgtaacagcagatgattttaaaatttacaagtgtcattaagatttctctcctagggtacaaatgttgttgtttcacagaatttttaaaaattattttatttattttttattctacttttatctctgggatacatgtgcagaacttgcagacctgccacataggcatacacgtggcatggtggtttgctgcacccatcaacccatcatctacattaggtatttctcctaatgctgtccctcccttagcccccagcccccgacaggccccgctgtgtgatgttcccctcactgtgtccttctgttctcattgttcaactcccacttataggtgagaacatgcggtgtttggttttctgttcttgtgttagtttgctgagaatgacgatttccagcttcatccatgtccctgcaaaggaaatgaactcatccttttttatggctgcatagtatttcatggtgtatatgtgccacattttccttatccagtctatcattgatgggcatttgggtcggaatttttataaaacttcaagcaaaccgaaactgacatactggctacttattttttttcttcataattctggatgtcagaaaatgaacaatgttctaatgcagaaggcaaactttctatgaaggaccagacagtaaatattttagctttgcaggccacatacgatctctatcacatacttctttgttatttcttacaacccttttaaatgtgtaaaaactattcctagctcatacaaaaacaggctattggtgggatttgcctcatagactgtagtttgctgacccctgctctagtataaatttgtcttgtttattactagagtgcttatgccagtaagtattttttaaaagagagagaaaatgcattaagtaaataacatttaagtgattctttttctgattcagacattttctgggatgaaatgagaccattgatcattttatttgatggaatagaactgtttttcattgcagtgcaatgaggttaggtatgattttgaggactggggaccattcagcacattagttctgaaccatatccttgtgctttgcagaatttttttctcttcctcagaggagcagtttgaatacagggctttatggcatcaggcataagctgccattaaaaccttcaactgaaaattgtgctgccctttatgaaaatgagcagctggtcagccggaccatcgcccaccctcagctctactcatgttgtgtacaagtagcttgaatagcccttcatgagcaggtcttctacagacattttcctatcagtgttgggagggaaagccagaccagcagctagtgtttctttcagcctgtgttgtgccttggcatctgactctctgtggacccaggagtgaaatatcttcctggaagtggtgatccaggttagtcttgtctctctgactcatgtcccaagttgcttccatagagatacctgtggcatcttttccccctttactctgttttcctgaatttccctctatttttcactgactacaaagataaagaaaaagaagaaacaattttaaaacatataaagtactttgaaatatttatccttggataactggagactagatcacattcttatcttttcatccagcatttttttttttggtgaataccatattatgtgtttaaaaagacatatggagacctgactcacactctgaatcttccaattttccattgaccacattcttaatgccctgagaacacaaggtcaggcaaaggagcctctcagctgaggtcctggccccaggccctaaacaggtcttctgtgagccaggccacagagttccttttggttggggtcagtcttagcagaatgtagatcctggagcaaatttggtcaagcagcttcctttgctcccatcaccctaagcctgcactggggcctgacttctggcatctcaccaatccagtcatgagggatggctggctcagaaagagcaccttgtcaaggaagaagcagctcaagatcacgaaagcccaagcacatttgtccctgtgcccagaacagagctagactggtctgcctctccctgcattcttggggctcttcactctgtgtattctcagggcaagggttgtaccaagggagagcacactgtccagcctcctctcaccaattcattcagtcatttacccactcaatacagatttagtgagtatctgtcatatgccagacacagttctaagtactgaagacacagaagtctttgctcattttactccataacttgctctgaagaggtgcctccaaggatcttactctttcatgggctctgttctcgatcacttttgctcagtattgtgaaacctatgggcctgtgatcagaaaaaaaatgtctttaaaccagtctaatccatgtcaaggtcctctttggaaggggagtagcaaggactggtgagaagggagctgtgagtgcttcttgaatgtaggacctgctccttactggggagaatagctcactcatttctaccttcctccaggtctcatgaacatgcacagtcctgtgtgttgcatctcctaatctcatctgattctctgctgtttgcctggtcttggactaatttccctttagcccacatgatgatctttaagttaagtctcagcctatttagactcaggctgcctcactcaccttgcagttgccatctttattatattatggcagtcaaaggttattttgtttggacagagaagttactctactgtatggtggactacctgtcctgaacgttcgcaaacatatccttttgttttctggagttcctcctggtttgttttctgatggatttctgttgactcccagattgaaccaatgtttatcctgtgtttggtgtatcaggcttttctgttctggttgatttcctgtagctaatttctagggagacttcaattcctcactgaagtcaagttccttgtcatagaggcccagtatttctaactcccattcagacagaaaatttgtttttattacccacaagagaaaatgatctggctttcctgctctaaagatacccctagtactactattttttccagtcttgtgttttcagatatttttctttaattgaccttctctatggtcagattcgtgactgtattccttcccctagtttattaattcttttttttttttttttttttgagatgaagtctcactctgtctcccaggctggagtgcagtggctcgatcttggctcactgtaagctctgcctcctgggttcatgccattctcctgcctcagcctcctgagtagctgggaccacaggtgcccgccaccacgcccggctaatttttttgtatttttagtagagacggggtttcactgtgttagacaggatggtctcgatctcctgaccttgtgatctgcccaccttggcctcccaaagtgctgggattacaggcgtaacccaccatgctctgccttattaatttctaagagtcttcctagaacactgtaagtatgcttaacctggtattatagagacatgtaacagaactaaatactttccactccacaaaagaagaggctattttgaactacatgtatcttcacagaggttactccagtaagtaacttgtggaagggagggtcattggaatatggaaacagacaaaataaaatctgttcccttttcctcaaacctcacatagcctcatacaattaaatgagatcttggttacctctcagcctgtaaagattcccctgagtgtgtatgtgtcaactcctgtcttggttcattttatgctgctataacagaatactgactgggtaatttataatgatcaggctgcgtgacttatgatgaacagaaatatatttgggttatggttctggaggctgagaagtccaagagcatgctggtggtatcttgtgagggccttcttgccatgtcataacatggcggaagccatcaaacggagtagagagaacatgcgcaagggtgggatagaagggggccaaactcatccttttatcagaaacacactcccatgataactcatttccctagcaacggtattaatccattcctgaaaacagagcccttatgattgtactgccccttaaaggtctcacctctcatccctgttgcattgaggattaagtttccaacagatgaactttgggggacatattcaaatcatagcaactccttattacccaaatttatcattatactggtcaacctacacattacaaatttacatttaaaaaaagtaattaagatttgctaaacttaaaagatttataagctgtaaaaaaaatcaaaaacaaaaacaaaaaaataaaaagcaaataatctttaaaaaatatgtacattttttaaatacaatgtactgacctgaaagtagtcaagttatctatagctactggttgataaaggcaacagaattgacagctcccacgtctgtaattaaatgtgtgaaactaacaaatggaaataatagagaaagattatttttctttactggtcatgttgtgacatcaatttgttttaaatgatgagaaaagaacttaaaggatttgctttttattatagtgcaaattaatattcaactactgaactgaaatagatttgcataagagttatcactatcaataatcatttgaaattcatttttcccagataaattagaatctccagtgataacaagcaagagttatctcctgcatttttgaaaaaaggttaaaataatagctatttcctataactagatcttgagattggacataaaccttatacgtgcaactttccttatctgattttaagtttcctttaactgtaaacatgagctaatgccacatgaaactaggaaaatacgatggaatttgaaaatgatgttagatagataaaagtaaggaaatcctagatttgaatgacatggaaatgtcacctagttcagtctcctgtaggggtacatagtgcctctagctgctatcatccttaatgatctccaaggaagaaagtagataaagatcctttcatcatcagttgtaggactgccctcaaccctgccccaaatattagatctttgaactctcttttagcagtaaatgttatgtaggtattaatatatatcttaaataacatatatgacagagatgatagaggtaataataataagtaatcactctccttattactctgaaaatattgtatatagcagtaatatcaaccacaatcaaaatgccatatattgagtatttgaatgggctagactctcctctgatcctttttttaaaagcatcattccactagtttccattgctattatccatgaagaaatagagacttagagaagataagtaattggctcatttccacagtttgtaagggacagagttgtaattcaggagcagaccacatacttcaaaccctcctgaccttgcatcatcatacagtaactgtgtatctattgaaaatctctagttaggtcccttctgagctttctgatctttgaattaattattttccatttctaacatttggccatagtgtcattttccagcattagtcacttacaaagatgtaggatgtgctattattttaaatccacattcatcaagaaaataggcctaattggagggaattaaggtagctgcaatttcctgatgattaagcactagaatatgttgctaggagaaactggagaattttcttttttgaaagtctgaaagaaaagtacaaataaggtttcaacaaactctaacttgaaccccagtttcctgatttgctaaatgaatggtttagagtaggtgatctcccttgggtctccccaaccctaacaacccacaagtctgtaactttaagtagcaattggatgttataacctctcaaggtcatttttagacttctatattttgcttcaatgattcttgactctctttggttcagctccacattctggagtttctttcaaatggagatctcataagagctattatttaacagtatcccaaatgtgcaatgtacagaattaaatacaaccatgcatttaagactttaacaatcatagttcatcagcactatgtgttctttctcctatttgattaaggttaaacaacaagatgatgtttcctcattgggtagcattttaaagtgtattgtgtatgtgacagatgagatcttataaatgcattaggcatgcttattttaatatctaagcatatgcaaaagttctagaaatattttacatgcaaatgtctggggctccactagggcccataatagaactccatactctgtgacttcaaagccctagtctcgacaactaatcacttggctatttccaaatcaaatttcttcaaacaaatcaaaggcatttgtcctacccaaaaaccaagttctgtggcaagtttcacatttcaaaatcaagctgcttattgagatattcatgcactgaaaaaggcacacagaatttcctttaggagatgagacacacctttttatgctccaatgaattagaaatttctcaaagagaattttaacaaattttctttacacacacacacacacacacacacacacatgcacttcatcttagcagtaaaagccaagattcagaatttcagcccaagagatctttcattttctgaaaggttatgagcccctgagatttcattcctttcagagtcataattactgtgttgcttctgagttgttaacaataacactgattaaaaggaagacaaaaaaaagaagagatcgttcacatacccgtattaagtggcttcacaaactaggagtatttttaacaccacaacatttgtggtaagtacaacaaagtgtgtaattcactgggaagcagaacagaaaagatgggaatgataatgtcaaataactcactttacccagggctccctgtgggcaaggcactgggccaagtcctccacaggcattgttgcatttaatacaacaatttttaacaatttttaataaaagccctccaatgaggcacttttactgtagcatttttacccatgaggaaactgaggttcagagaagttgaataacttgacaagagtcacccagactcccaagcctctgttcttaattgctcaactatgctactgccttttcttttatttttattattattattatactttaaattctagggcacatgtgcacaatgtgcaggtttgttacatatgtatacatgtgccatgctggtgtgctgcacccattaactcatcatttacattagttatatctcctaatgctatccctcccccctccccccaccccaccagaggcccgggtgtgtgatgttccccttcctgtgtccatctgttctcattgttcaattcccacctatgagtgagaacatgtggtgtttggttttttgtccttgcgacagtttgctgagaatgatagtttccagcttcatccatgtccctacaaaggacatgaacttatcctttttatggctgcatattgttccatggtgtatatgtgccacattttcttaatccagtctatcactgatggacatttgggttggttccaagtctttgctgttgtgaatagtgccgcaataaacatacgtgtgcatgtgtctttatagcagcatgatttgtaatccttcgggtatatacccagtaatgggatggctgggtcaaatggtatttctagttctagatccctgaagaatcgccatactgtcttccacaatggttgaactagtttacagtcccaccaacagtgtaaaagtgttcctatttctccacatcctctccagcacttgttctttcctgattttttaatgattgccattctaactggtgtgagatggtatctcattgtggctttgatttacatttctctgatggccagtgatgatgagcattttttcatgtgtctgttggctgcataagtgtcttcttttgagaagtgtctgttcatatcctttgcccactttttgatggggttgtttgtttttttcttgtaaatttgagttctttgtagattctggatattagccctttttcagataagtagattgcaaaaattttcttccattctgtaggttgcctgttcactctgatggtagtttcttttgctgtgcagaagctctttagtttaattagatcctatttgtcagttttggcttttgttgccattgctctttgtgttttagacatgaagtccttgcccatgcctatggcctgaatggtattgcctaagttttcttccagggtttttatggttttaggtctaacatttaagtcttcaatccatcttgaattaatttttgtatacggtgcaaggaaggcatccagtttcagctttctacatacggctagccagctttcccagcaccatttattaaatagggaatcctttccccatttcttgtttttgtcaggtttgtcaaagatcagatggttgtaaatgtgtggtattatttctgagggctctcttctgttccattagtctatatgtctgttttggtaccagtaccatgctgttttggttactgtagccttgtagcagagtttgaagtcaggtagcatgatgcctccagctttgttcttttggcttaggattgacttggcaatgtgggctcttttttggttccatatgaactttaaagtagttttttccaattctgtgaagaaagtcatttgtagcttaatggggatggcattgaatctataaattaccttgggcagtatggccattttcacaatattgattcttcctatccatgagcatggaatgttcttccatttgtttgtgtcctcttttatttcgttgagcagtggtttgtagttctccttgaagaggtccttcacatcccttgtaagttggatttctaggtattttattctctttgaagcaattgtgaatgggagttcactcatgatttggctctctgtttgtctgttattggtgtataagaatgcttgtgatttttgcacattgattttgtatcctgagactttgctgatgtttcttatcagcttaaggagattttgggctgagacaatggggttttctaaatatacaatcatgtcatctgcaaacagggacaatttgacttcctcttttcctaactgaataccctttctttctttctcctgcctgaatgccctggccagaacttccaacactatactgaataggagtggtgagagacgcatccctgtcttgtgccagttttcaaagggaatgcttccagtttttgcccattcagtatgatattggctgtgggtttgtcataaatagctcttattattttgagatacatcccatcaatacttaatttattgagagtttttagcatgaaaggctgttgaatttcgtcaaaggccttttctgcatctattgagataaccatgtggtagttgtctttggctctatttatatgctggattacgtttattgatttgcatacgtcaaaccagccttgcatcccagggaagaagcccacttgatcatggtggataagctttttgatgtgctgctggattcggtttgccagtattttactgaggatttttgcatcgatgttcatcagggatattggtctaaaattctctttttttgttgtgtgtctaccaggctttggtatcaggatgatgctggcctcataaaatgagttagggaggtttccctctttttctattgattggaatagtttcagaaggaatggtaccagctcctccttgtacctctggtagaattaggctgtgaatccatctggtcctggactttttttggttggtaggctattaattattgcctcaatttcagagcctgttattggtctattcagggattcaacttcttcctggtttagtcttgggaggatgtatgtgtccaggaatttatccatttcttctagattttctagtttatttgcatagaggtgtttataatattctctgatggttgtttgtatttctgtgggatcagtggtgatatcccctttatgattttttattgtgtctatttgattcttctctgttttcttctttattagtcttgctagtgatctatcaattttgttgatcctttcaaaaaactagctcctggattcattgatttttttgaagggttttttgtgtctctatctccttcagttcttctctgatcttagctatttcttgccttctgctagcttttgaatgtgtttgctctagcttctgtagttcttttaattgtgatgttagggtgtccattttagatctttcctgctttctcttgtggacatttagtactataaatttccctctacacactgctttgaacgtgtcccagagattctggtatgttgtgtctttgttctcattggtttcaaagaacatctttatttctgccttcattttgttatgcacccagtagtcattcaggagcaggttgttcagtttccatgtagttgagcagttttgagtgagtttcttaatcctgagttctggtttgattgcactgtgatctgagagacagtttgttataatttctgttcttttacatttgctaaggagtgctttacttccaactatgtggtcaattttggaataagtgcgatgtggtgatgagaagaatgtatattttgttgatttggggtggagatttctgtagatgtctattaggtctgcttggtgcagagctgagttcaattcctggatatccttgttaaccttctgtctcattgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttcgtctttgttggtttaaagtctgttttatcagagactaagattgcaacccttgccttttttttgttttccctttgcttgatagatcttctgccatccctttattttgagcctatatgtgtctctgcatgtgagatggatctcctgaatacagcacactggtgagtcttgactctttatccaatttgccagtctgtgtcttttaattggggcatttagcccatttacatttaaggttaatattgttatgtgtgaatttgatcctgtcattatgatgttagctggttattttgctcgttagttgatgcagtttcttcctagcctcgatggtctttacaatttggcatgtttctgcagtggctcgtaccggttgttcctttccatgtttagtgcttccttcaggagctcttttagggcaggcctggtggtgacaaaatctctcagcatttgcttgtctgtaaaggattttatttctccttcatttgtgaagcttagtttggctggatatgaaattctggattgaaaattcttctctttaagaatgttgaatattggcccctactctcttctggcttgtagagtttctgccaagagatcagctgttagtctgatagccttccctttgtgggtaacccgacctttctctctggctgcccttaacattttttccttcatttcaactttggtgaaactgacaattatatgtcttggagtttctcttctaaaggagtatctttgtggtgttttctgcatttcctgaatttgaatgttggcctgcctcgctaggttgggggagttctcctggataatatcctgcagagtgttttccaacttggttccattctccccgtcactttcaggtacaccaatcagacatagatttggtcttttcacatagtcccatatttcttggaggctttgttcatttctttttgctctcttttctctaaacctctcttctcgcttcatttcattcatttgatcttcaatcactgttaccctttcttccagttgatcgaatcggctactgaagcttgtgcattcatcgcgtagttctcgtgccatggttttcagctccatcaggtcatttaaggacttctctacattggttgttctagttagccatttgtctaatcttttttcaaggtttttagcttctttgagatgggttcgaacttcctcctttagcttggagaagtttgatcatatgaagccttcttctctctacttgtcaaagtcattctccatccacctttgttccgttggctggcgaggagctgtgttactttggagggggagaggcactctgattttcagaattttcagcttttctgctctgtttttcccccatctttgtggttttgtctaccttggtctttgatgatggtgatgtacagatggggttttggtgtgggtgccctttctgtttgttagttttccttctaacagtcaggaccctcagctgcaggtctgttggagtttgctggaggtcaactccagaccctgtttgcctgggtatcagcagcggaggctgcagaacagagaagaataaaaccagaagtcctgggaagaagagtgatatagtctggatatttgtccctgcccaaatctcatgctgaaatataatcccccatgttggagctagggcctggtggaaggtgtttggatgataaagactgatccttcatgaatggcttgggacatcccctttgtggtaagtgagatcttgccaagttcacatgagatctggtcatttaaaagtgtgtggcacctccacccccactctctctcatttgctcctgcttttgtcatgtgatgtgccggctaccccttcaccttctgtgttgattgttaagttttctgaggcctccctagaagccaaccaggcgctagcaccatgcttcctgtaaagcccgcaaaaccatgagccgattaaaacacttctctttataaattacccaatctcaggtatttctttacagcaatgcaaaaacagccaatacaaagtggtaactaacaacatgaaaaccagggtaagcttagatccatgctgtatttatacaggctggcccagagccaacacttaatacatatttgttgaataaataaattcatgggtgaattcaagacattgtaaaataatttatggggcatactggccctttgacccccactagtcatccagtccattccagcatctgtcagttagttgtccatgagtctgtaatggaacctggcttccactcccagagccagctctgcacaaatttgtgaagaacaaaatgcctacctggcagcctctaccttctcttgttctttgctgggactgctattttccaagcctgtgttctctttcacgctggccattgactgtccagaactggctgttgactgtccagcaggcccagggcaagctccactcatagaaattgtgtgatcatctttcttcttcctttcttttctctattccagtcagaatttcagcatttctggaagcaattgcttgtttgcttatctgccttcttcttcacacagtaagatatgtgaagacaggagctgcatcattattatatctccagtgcctggcatcgtacttggaaaaaagtagttgtttagtcaacatttattacttaaattaatgaatgaatgcatggatggatgagtgttctccattgcaaacattgcttatcaagattgcaggtatttgagtactattactattaattgttatggtaatattgaacttatttggaagtattactgttggaagaaacatattttgcaggtgtgtgtgtgtgtgtgtaaaactattatgttcctcatttattcaacaaatatttattgagtatgtactatgtgacaggcactagggtatattattatgttgttgttgaccattatcttccaccatccctttaaatattttaggagagttctctctctctctctccctctcgctcttgctcttgctctctgtctctctcttcccctctttctctttttgcatgtggatgaaaattccaaaaggatctataattttctgcataatagacatcctgaaatgccttgacgtcagaaacacagtctcaattcaggaaatatgatttgcagttccatggaataatcaaaactctgaacttgagtaaatattaagccttctccacttccaaaggtggagccctgcttcaaggaggggtcacgggacttaggtgcgttctccgccctctccatgctgacctcttttctcacctgatctgcccagctcagggctggacaagaggtgggagggaagaaaagtggataggaccttagtctcactagttcttactcgctgttagttctctgagcctggcgtatagttccagttgtacctggttgaagaagcttttatgtcctcttcagagatcccccgacaggccatttctggtgattcttccctaagccccaggtagctggagggcacataccctcggtgtaaatcttccagacagactttcaggtatgatgtaagaaaatcccacacttgctgtctcactcacatggccctcatatgcttcatgggaaacatttacatccctgccccgacagcctctgggagttaggggtcagttaggcatcagtcctctctatctcctgacccgaaaatagcccacggacctttcgatgaccctcttgcatgtcccctctccagacctgaggtagaaataggaaggtggagatggctagagaggcgagagttttctgatgagattcctctcctgactctcctgctcaccacactctaggcctacttgaattctcaaagcagatagtaagttctaggatccagagacttaaaaaaaaatctgcatttagtaggttggccttggaaatttccattttattttgtagtctccttagacacttcaattttgggcacattattgtatatagtatatgatatatacttatatgttatatattatatataagttatatgagatatatatttatatatcaatatattgtatagatagtgtgtgtgtttctatgtatctcaagtgttttgaacacaacttgcggaatgcaataaaattattttgccacctctccctttaaaatatattcagttctttctctgctcctggatgaatactccacttgggcattctcagagcttttctaatatctcttggagaatagaaagtattctggtctcttaaagaataaaatgttgccacaatttgatattttaagtgtccagttccacgtaatagtcaaacctcccatcttcattcaaagttacacctactccccgtcttcccagtgggcctgcagtctgggaatatgatgcatttagtttcttttttttctttttttctttttttttgtttttttttgagacagagtttgactcttgttgcccaggctggagtgcaatggcgtgatctcagctcaccacaacatccacctcctgggttcaattgattctccttcctcagcctcccaagtagctgggattacggacatgcgccaccacgcccggctaattttttatttttagtagagatggggtttctccaagttggtcaggctggtctcgaactcccaacctcaggtgatccgcccaccttggccttccaaagtgctgggattacaggtgtgagccaccgcacctggccaatttcttttctttttcttgctcctcactgccctagctagctgctatttatagaccatttggagttgaagcaagagggttggaggagaggcaagatcttacatcaacagttttgctgtaagctggcctcatattttctgggtctggccaatattaaaactctttgtctcatgggatactttcagaggttctttgaaatgcccatcccaccactgtgctgggaaactttcagcagcacagttctcttgatacagatcatgtattttcctgacttgtttcctacttcttccacagtctctaggaattgggaggtggtgttcacccctggcttccacatgctgagttttcagtctcccatctcaaaggccccattgagcaggatggagtaagcacaacctcattctgagtgccttgtttgtaggcctgtgtttaatctaagggaaacataaaacctctactcctagaaactctaggagacacatctgccattgttaccactggaagtgagatgccagttcactatatctccccagctacagggcatagataccaaatttccaagagattttgtcagaatctctttcactagtagaagtgaaggggcaagcactcctttggaagagggacatcaaagtacagttcttgctaaagaaattccccctcaaattctttcttctctcaaaccttttatatcctcagtgtgcctgaattgtctacaagccatgtaattagtttttgttatctctttttcaagtcctacaggctggcctgttgcatagatcattttcgtctctgataaccgtgaaagctgagtgttcagccaaaatttccaattaaacatcctgatatgtacataattagatatacacaactgtcctgtggcatcagcagcatatattgttattcctgtttgatgtatgagtaacctaaagtacagacaagtgaagtaacctgcaccatgactagttgggttttctcactccatgtcttcactctttccctgactgagttaacacattgtccttttaagaacggactgaaggtccagcgagtagatgaacagaagtaaccttattggtgttgcacaggcctacaaaattactaagaagtccttacaacaaataaatataacacatatttcatgggaagtaaaataaaatagtagacttaatgatggtttagaataagtagtattaagtaaggaaaatagactgacataaaaaagaaacaaaaaaagactgaaaaatataggtatagtaaaaattaaaagaaaaacattatctattattgaaaattaagcatctgattatgtgataataaaagcttaacgtagtttgcccaggtttgaaagaaaactgattgacagtcgcttatcaccaataatgaaccccacctgtgccatagaaagtgtcttgggacaccaaaccacccgccaacccccatgttgtaacatcacagtagtacaaggatgtagatgcaccaacctaatttgaatgtgaagtagtccgtggtataggacagcatacgtacaagcccaccctgagggaaatactgagcaagaatctaggtgggctgaaaataagagaatgaataaaggaaggagaacagggttaaataaatatgtgagatgaagcatatggtttgagaagttttggggtcccacagatctattgcagggtactactggtaatgacactcatgaaccatgtaccttcacctgttctactaactattttcttgagtaaagaggtcatcttctggtgccttgggattgggactgcttaagtcatttctaaccctacattcttacttccctttagggttaggcctagaaggagaaagaggaaggacatgaaacaaagagttgacaccttctttttttttttttcttattttaaaggtaccatcagacctctcttatacttcattttacttcccaccacattcaatttcagattttttgttcaattgcttatatcatttagcaaccattcaaaattgaatgctgcctttggaaataaagaacatctgctctaaatcttgttgtgctggagattttgcaagaagctagagaggcagatgctgccatatagagttggcaaagtccaaaagacatgacttacaggcacaccaagcctagagaaactgataagaagtagtgctgcaaaataacccttagaggaggacttgtaaagcaaaggaatttagaggatactagaagtagaaatgtgatccaagtatgaaataaaaacacaatagctacagctataataccttcgcctctagtctcttttctcaagcctagtcttcactcctgattttgcactgtgatctcaaagtactgattcctgattttgattgaccatttctcaaatttcccctattaatttggaatcttctagttttctacatatgggccttcctggaccatacacagagaatgcctctctctctgttttaaatgggataacagatatagatgttatctccccagaataaaagagagtacaaatgttgggtctgacttctgtcttattattattcagtttggtctgatttcaggatctgtttaacatgtattgatttatctgttaggcccactttgtcattttaacatgcatattaaaaaaagaagaggtattgaattcagccattcagatctttttcaaattggaagcaacttcagaaatctccacaatctgaaaatgttcctgtgtgtagggccatttcctcaggggatatgaacagtttcatgaagatgtcccacacctccagatttgtcctctttttcatcagagctcctttcttatctttgcctgggcccttaggagggctttctgccatgtcagtatcctgtcaatttctacaactctatgaagtttttcacatagtagaatatattgtcaaaatgtcttgatgtcttattacaacctttacccaatctcggcagcaggatttctgaacacactcctggtgcctttttcctgatacatttattatctattgtgagagttaaatggtatctcgaccacatcctgttcttcctagaatccatatcaccttaaacatctagtagtctcatttctgacattctggtggggaaacctatttttaggtaaagttgcttatttttgttggaggaacgtttgattttactaagtctcttaagtttcttgaattaggttttctaatctatttgttcattcacaaatatttattgagtgtatattagagttctccaggggaataggactaataggatgtgtgcatgtgtatatatatatatatatatatatatatatatatatatatacacacacacacacacactttccctactttcttccacttattacccttggctgaagcatgaaaatatatttcatgtgtataaacacacacacacacacacacacacacacacacactttccctactttcttccacttattacccttggctgaagcataaaaatatatttcatgtgtatgcgcacacacacacacacacacacacacacacactttccctactttcttccacttattacccttggccgaagcatgaaaatatatttcatgtgtatgcacacacacacacacacacacacacatatatatgtaggaagagatttattgtgaactggctcatgtgattatggaaattgacaagttctaagatttgaagtcagcaagtaggaaaccccaaagagccaatggtatagttcccatttgaaggctggcaggcttgagactctgaaaaagcagatgtttcagtttgagtctgaaggctgaaaaacatgatgtcccagctcaaggcagtcaggcaggaggaaattccctcttactcatgagaaggtcagtctttttgttctattcagatcttcagcagattggatgaggcatcccccacattaggaagggcaatctgctttactcagtctactgattcaaatgttaatctcctcccaaaacaccctcacagacatgcccaggataatgtttgaccaaatacctgggtactccatgagccagtcaagttgacacataaattaaccgtaacatgtacatactgtgtgtatgccaggtacttacttaacagatccttttttactgttaattttattattataaatgtggctgagaaaacagtatattcttcgtaatattgttgcaaatgaatcaggcagatatttaagggtaggatttcttgttctgttgggaagatacgtatgactgcctttgtcatctcaaacaaagttgcaaaaagtgtcatgacttagggtaactaatggtaagtaccatggtaatcaatccctaaattttctagtttaatttaaaaaaaattatttctaacttacttcactgtctgatgaaggccaggaaactctcctaggtaacttacctccaagttgtagaattcaggcccctttcatgtgtttaaatataacctttttttcttcccctccaactccccttcctaaagataaacttttaaatcaataggtatctcacagtactttgtgaaggaaggtaaaataaagtcaactcgaaaattgtatatttaattgattactgacctctataatttaaaagctgcttgatcttggacaaataattctttttcattgatgatcttggaacccagtgggaaagaactacagaacgaaatggtaaatcaaatatcgaagatgttttgttacttgaggaatcttctgttaggttggtatagcggaggaaaccttccaattgagttttgagtttaagtaacaagttttgctcatcaagctgggcaatctgggcaaaccaattaaccactctgggctttggtttcctcatttgaaacttagcatgttagccacactgattttgctaacatcacttccaaatcaaaattgcaattattctagtagaccatctctttagatctggattaaggatgaggcctacttggaggtgaaggaatcaagtagaaagatgtgaaatggtccctccctccatatggaaaaatctgcctgagatttagacagacactattcaaaactgtaagtccactgagcaccaactgcggtacaaaaagttaagttcccaggtctcatttacagagtagtagctgcttgttagttatcacacgccagtgattcagctggagaagctaaggcagaaggcaattatgtaaccatcacaaaagggtatgggggaagcacttgaacccataccgggcattctggcttctggtcagatgcgagggatggattcaatgtcattttaatctttattcattgtttcaatctgttagaactgttatagtttggagctccatacagaatgcagatttgttcaaatgacttcccaagaacttgtagcaagagcacttggagccatcctggacaggcccatgctgtgcctcacacatgcacagcatcttcaaggggtcatacagaaactgcctccaaacctccccacccacttccactttgccacaaccccaagagaggacacccatctcaaaaaggtttgctttcctgtggagtaagaggtataattaaattgtgtcccagcagtgaaggttccttaatgataatgagccaaaactaattgtattgatttgtttatcaccggcttaggaggcccatcaaacaaatggactgagactatttccatattcttatctgttaggtaaatgagaaacaaatgacctctccctatgtctgcatcctgaagtcactgccctctaaggctgagtgctctatggcttcgggtgggagctttgtccaaagctggggccattctgccctctggcttcttcaaataggtgaagaaagttgaaaattttggtattcattcttctatttttcatttatgtagaaggatttgtttttaacagttacaatttggatccttgccaaaggtgccagatggcctgctttcttcgggagagctggtcatgagtattaataaccctaatttggaattctctgtggaaggggtagccacaagatttggagtgggaggaaatgtagaatcattgataacaagtgaattcagagaaaaagactcttgaatcttggtcaggagtgagacataacggtaggcaggcagctttggggggccacaggagaagcctgatgtacctgcacctacccctcttagtcttggggagccttcccaatctactgctccacaaattaagagaaatagagagaattaaaagagagctctggaagagccatagcaaagtccagagttaggttattgagctcaagtggaaagggataaaataaatggcttccagaatgtgaagaaattagctgcaagaatgtgaaactaaacagtggatctgtgactattcactttcactgagatgaaggagcaaagctcaacctagtatttagaaaagatttagggggacatagaaagaaaaccaacatctattgagttcgtgttctcctcccgttacttggctaaagagtggttaggagtgagcctgacatatattgtttctttaattcttttgcctagcccagcaggtaggtatacatatcccattttggagaggaggcagctatgtgtccagttaatgtttgtaaatttaaagccactatcatctgcatcaaagcccatactctcaacggctgaagactgatatctcactctccttcctcatctttccaatagaaagcaaggagttccattcagcacctctatgtgggcagtattgaagaggatgagcctttcttcctgtctcacttgcccttacgctcttcaaagggagggcctcatctgaaaagggagatagcctgaagccctttgactgcattgatcagggacaggaccatgatattgttacatacctaggtcaccctatggctgagctctctcttatgccctttacaccaatctgtgtcctgctccaagggccttgcccctgtgactcttattcagtaaacaggccacacagctgcttctggtagcccaggcagaactctgagcagaatcctggtctctgtttcagtttgcacctggtggccaagtcagagttgtaaagtcccaagatttaagtttagagaaggttgtcagagatcctttcatattccccaattccttttatcataaatacagctgatgctctattttcatcaccagtttgctctttctttttatcctcaattgattagattccctaggaaaagaggagtgagtacataggtaatttttctaaacaccaatctctactactgatgagacaaatggggagctttccaaatgtgagggtcattcaggtgacctgatggcttatggtgactgggatggtttaaagagaattttgattaacaggagaaagagttttttaggaaacctctaaacttgcttgaagctgatttagttgatcctgcaaagctgcgctatttttcacctaattcgagagtttattttagaggtattcatcttctaaaaatattttacctttaaccaccattttcggacataaactactttatcatttatgtagactttgaggagttaaaagcttttggtaaatcttgcctcctttgattcgcaacaaagcagaaaaaaaaaaaacggagaagaaatttcctctttgtaaaggaaaaaatttatttaattttaaatgacttgtccaaggtcacttggctggaaagtgtctgggaagagactctgcttttctgtgttctgagttggccttaaattattgcaatacttcacatacaaaaataaaaaagaaagataaatttgattatataagaatgtaagtctcctgcacagccataaatattaattaaacaatataagataaataacaaataggggagtaatttaccccactagacaacagggttaattttcttaatatataacaatctccttgaatagcaataaaatgtataaacaaccaaatacaaaataggcaaagaaggaaacatgcaattagtcaatgaccatgaaaagatgcttaaacttatatagttaaagaaatgccactgacttatcatttttcactaactggcataattaaaaatcttgatgtaatgttggtaagaatatggggaaaaactgttggtgggagtataatttgagacagcttttccggaagggaattggcagtatttattgtaacctattagtaatgtctgcaatatctggtagggtgtgaacattgagttccattagcagaaataaagtattcctggagttacaggataaagcacttatcaaaccacacagagtccaaatcatgcaaatcagaaggcttcctctctaatcaccttattaatcccctctcttagcttcctccacagctggtctttttatctttcaggtctttcccaggtttgcagcttccacgttctcggttctactcagttctcctttggtaggagcctgttttgttctttggaccttgggctttagtggaggggaggggtccttaggaccttcacagtgaaaatgtactcagtaataaaacatttcccttgctgattttgactactacttataattcaaatgtgctatgctaatagaacctccctcttagtgtgcaagagagaaaatgaaggaggaatgaaaaattataatcaattacaatataaagtggcccagaattgacagatggaggaatctattccatggatgtacttgcaacagtatctgaagatacatctgagaaagtaattgaaactttgtaattgcagaacataaaatgtaaatagccgtaaatagacaaccgacaaaataaagcatggtgaatttctaactggaatactatgcgatccttaagaatggggcagatcttccattatgctctaatagaaagttacctagaatacaaaagaatctcatcttcttcaatgtggagatttaaaaaaaaaagcctttggccaacttaaatatacatgcttttagaatcataaatgaaattattgaatgtttacttatatttaatttattaatctagttacacattcacatttaagattgcatatcatataacctattacttcagaaatatttctactttttgcatttcttgaatcagtattatatgaatacttcacatacatttttgacattagtcttttacaagctggagctgctttctgagtcatctgatacatattttttcagagtacattttccttatttccatctgttacttgagatacagcatttgttgacccacatatgatgctatcactggcaattttatcacaaactacaagtacccattcatagaacatcagtaaaactgttttattaagattcattctgtagggctgtatgttggatctcacaacacaactacttattctgttgctttgtaaataatctttgaaaggcttgtttttacaattttaagcttgaagctttttgtcttactccaagaaataaagactaatctgtgataaatttattttccccttttaatcaatgtcacaggtgaccacaataggtatacaaactcatgttgaccgagattgtttcaggctaatgtgtctttcccaaacaataatctttagttcaaaattaagtaataaagaaagcttctcataatctcagagactttgcaaagacctggtgataattccctttcttttctgaaagataattttagcagagtaacctcatcatttactcaggcatttgtggaatgtatatagatgtacactcaagtattcaagatatattctgaagtaaaaggacagattgtagaatagtatttacagtgaacccatttgtagaaaataaaaaggctacaccagtaaatgttatctataattatatgtaactacatattcataaacccttcctggaataatacattgtgattaatcctaaggtagtggggggaagaccccaggaggaggaggaagactggaatgttttctctttttacccttgttccaatgttgtcagtgatgtattaaatgaaaattggttttaaaatacatgcctttccttttacttcctcccctctccctccccctacaagctatttctcatttggagttttgcttgctattatcttgagccaaattaaaccagtgatctcctgatggaaaaggccagagcctgttcaatgactccagcccctttcctgtccattctcctctggagccatcaccaaagccctggtcacactctgtaatttgtaaatcctgaaattgtggtttgcaaggcaaatgattcagagcaagggctttatcccgggatcttatcctcctagttgcacaaaaacaaacaccagggacaagaaaattccttccttccttccttctttcttttttcgtcttctctttttattctgggtaaagggagctaaaaagcaggagaggaggtcagtttgtggaaaatgaactgaaggaagtgaattgtaagagatgggtcaaagaaagaaaaaaaaccacgcctaataaggaagctaactgcagtttttccaaataaattaaacgaaagataaagaggcaggctatcaaggcagcctaaataaggacacctcaaaaggaagaacgaggaacaaagcttcagaagcttcaacaggagaacaaagaggaagaggaagcggtgtttaatgagtgcacagtatgaagccggaggctgactgctttggtttgctgttagaatctccagctaacagtgcctaaacaataaaagtttatttcttcttaagacaagcagtctggatataggcagtcactggaattgattcaacaaatcaatgaaatcagagctcctgatcagttcagcaatttctgtgatacttttctcctcttcaatgttcccacgttctgagacggctgcagcagcatcaagcatcacatactcccacaatccactttcaaagccttgagacaaagggcaacacaggccagtgttgctcctcctgtgcgcctcttatcaggaaaaaaaatatctttctcagagccccacagcagcctccctttatatctcatgggccatagctctgtcacaagctcaccctgttccagggattgcctctacctatttgagatcaagggatctcttcctgttacctaaagaaaaattagagcactgttaattagcaagaaaaggtgatgtcttggaaaaagcagccaacaacttctgccacattaaataatctccataaaccaccttttgaggtaactattattattgccatttgaattagtttgctagggttgccaaagaaaaagaccacaaactgggtgcctgaaacatcagaagtttattgtctcatagttctgaagactagaagtccaaaatctggatgtcagcagagttggttctttctgagggctgtgaggggcagatttgctctagacctctctctttggcttgttaatgagtcttttcactatatctcttcacataatcttccttctctgcatgtctgtgtccagatttcctccttttatagagacagcagtcagattggattaaggcccatcctaacaaccaagtaagttaacaatttcaacttaattacctctataaagaccctatctccactttctgaagttggggggtaagtatttagacgtataaattttaaaagggcacaattcaacctgtaacaccattgtacagaagaaaccgggtagtagagattagataacttgcccaagaccacagtagctccaaacgtacacctgccttacaacaaacttgtgttctttccaccataacacaagaaaacaaaagttaataagtgagaaatagagtgaatgaacaatactaaaatatttctaatgcatatgacagaggtgtaggactattataaggatgtgtgggcaaaaatacagattttcagctaaaacattttaattcgtatctcagtgtaggtaaggttgaaattaagagttgtacgctaaataacctgaaacggaacttacaagttgggtgctttaagctctatacaccaaaatcaatgaagccatgaaaagaatataaggaagggggcagagaggataactggctggccagcactgtcagcaagcaggatttgccaaagagaaagtcatccaatggcaacacctctctcagagctcactctcttgccttcacttctttgttctgaatgtgtgtcccactgattctcgcattcctacaaacttgcatcctgactgcccaactcccctccatttggcttagctctgccgcagtcaggcaggaagaacgcccactggggcctgctcatttgcttttacagttttataccactgcaacttgctatgcctctctttcccacatctagggcaccctttagataggaatgctgggttcattcctgctgaggtgttactgactggtaatagcaaaatctgttcctgtcttgcaggatgaatgtgtacttttacagagaatacagtctcaattcaaagaattcttaatatttttttcccacaaagtgggtagtctaataagatgtagaggagaaggagctttgagaaagctggagaagtcttgaaatctggacaagtgtgctagacactgttagtgactgcctgctctaaacattctgttcattgcagtagcaatagtagtagtagtaatcagctgaaatgtgtgtttggtcctaatcaggactgaataatctggaaagtctttacaaactcggctcaaccatcccctcttccagaaggcttccctgactacatcttgttcactttctgggttggttgtcctctatggcatcctcacagttccctatccattctaatgcattgtcactgttggtttattggacattcttccccaggcaaccacaaacttttcagaggaaggaactgggttttttatctctatatggcaagtaccaagcccagaacctggcatgttgctgatatttgtattaggttcctaggctgccatagaaaattcggtggcttaaaacaacagaaatttattctgtcacagttctggagaccagaattcagaaatcaaggtgtcagcaatgttggtttcttctggaggctctgagaggcaatgtgtcccatgcctttctcctaaattctatggctgctgactacacctggcattccttggcataaagcagtgtaactcccatctctgcctccttcttcacatggaatttccctgtgtgtctttttatctgtttcttcttctcttataagaacttgtgattggatttaaggcccaccctaatccagggttatatcatctaataatgatccttaccttaattacatctgcaaaggcctttattccatgtaagacgacattctgaggttctgggtggacatagttttggggagccaccattcaacctgatacaatattgaataagtatctggggaataaataaatgaacagtcaacatggctccaatatctagtgtgaagaattatactttcataccacatgaaagtaatctgtatttaaagtatacaagaaacccaactgatgctcgaggaacctttatatgcttgtgttaaatggtaagactaagttactttgggctttcactgtatagagtcttagatttgaaagaacctaatgtgttctttggccctggaatgtgatagatcatattaaagtgaggttttaatattgtaagatttatatgatttgctatttgagcttttctaaactattaagtagtagtatctattagtgtcaatactaggtattcagttattttaataagaagcatattaataggatcacatgcactgtcatttttttctatcgtacttcagatgtggcctcattcaaggatagagcagtcagaggcttccagtatttctctctcatacggtaatttcacacttgaaactcagcatacacaatgaggaaatagatatctttccgtcatagtcctgctaaacagaaaacaattctctattagttaatgtggccaaatattttctggtacctagtagaagcattatttttagtagcgatagaagcaggaaatgggaagccaaagctttttttttttttcagacagagtctcgctctgtcacccaggctggagtgcagaggcgcggtctcagctcactgcaacctctgcctcccgggttcaagcaatttcctgcctcagtctcccgagtagctgggactacaggtgcgtgccaccatgcccagctaattttttgtatttttactagagatggggtttcaccatgttggccaggatggtctcgatctcctgacctagtgatccacccaccttggcttcccaaagtgctgggattacaggcatgagccactgcgcctggccaccaaaactatttttaaaatttgggtatatgtcaaatagcatttagacattaatcaaactacagcttgtcctacatcatcaattattgacaccacagggaatgattgtcattcacttataaatagctccaagcaaaacctagacagggtccagaatggcaagactcagtctaactttagaattttatttccaaagaagcaaagatctcaataagtttggaagtagaatcacctcaacatccctggagaagcagatctagtccctctggctgtgcattgcttgaaatgcagtgttgtatcatatattaaaacactgaaaatggagttcagcatggagagccctaggctacactatcatgaatctttcacctttgctaatcttaaagtcagaaataattttaaaatagatgcatggggcaacgtgtgcatggggaaagtgggtgcagcttaaatttcagtgccaggaacagtgtcgatttggccattcatacctgtcaatagctgctgagggtaaccttcttatttaactgcagagaaaaaaaaagatgaaatatgttcatctcctaccttgagacataatcattatttaataaggcactatatatgaaacatgggctttatttgacacatggatatgctaataagctccagaatattgctaggctctttgaaatggaggctgtgagatcatgatagtcagtcgcttgtttacaatacatgtagaaccctttactctgctgaatcttgaggcccttgcaaatttgtattagctgatgtctacgtggtgcagggaaagcaaccatttctggtactactgacatacgacagaagtgatattgcattaaaatggaaaagaaagagaagactcatatcccaggaaggaaggaatctgggcctgtctcaggcaaaactgtgaattaaatgaaagatctctaaaacttcatatcttggcctaatggtcacttttttctttcagtggtctgcttaagcagattttaattgccctgaggctttctttccctggctgtgtgcatcttcccagtcacctttgctgaggttatcaacatagcaaaaccctccctaggttgtgccacatgctccagactttcccaacccatttctcaaaaatatcaagtaattactgcgtttggttccatattgggggatttatctaggaatatatcgacatgcttttctttccaagacacatttatacttgaaggtagactgcgaagttttattccaaaggagacactaataaagggcgtttcaggttccaggcaggtgccttggctagtgaaaagaggcagaccgcggtagacaatatgtctaaagaagcttggatcagatgacaacactcaaatcatgtcacaaaggcaatcagctgtcacctctccatgtagggaaggccgtggagaaatgactggaagtcaatagaagtaaatatatatgaatgttgacatagtggagtggagccttggagcatgagtgaaatagcagaaataaatatttaaagtgaacatttctttgggaacaatgaaaagtgacatgcagttgagctctggcagaagttttcagaaagaagcaagcaggatcaaacacatgcctctgctgttcattatttcacaaacagacaaaactcaaattctgactagtccagagctatatcgctcaggagctgctgctagcttcaatcctgttggtcctaagtataaggtaggtgaacttggagggagaggtcgctggaggaggtaatatggtcaagtaaccagtgacacagctcaagaaatcatctttattggacatatttattcttttcacttcttttttccttttcttttttaaaataaaacagctttattaggatataattcacatgctatataatttacccatttaaagtgtataattcaatggcttttagtatattcagagttgtgcaatcattctcacaatcaattttaggacactttcaccactccaaaattaagccgcatacctcttagccaacacctctcaggccccccaacacttgctgggcccttgaaaccaccaatctactttctgtctctataggtttgcctattctggctattccatataaatgcactgataaatatgtggtctattgtgagtgacgtaatgttttcaaggttcgtctgtattgtagcatgtatctgtacttcattcatttttatggctaagttatactctgtcatattatggaaataccacagttcatttatccactcatcctctgacagacatttgggttatttctactttttggctattattatcatgtggttatgaacattcctttacaactctttgtgtggacacaggttttcctttctcttgggtaaatacctagaagtggaattgttaggtcatatgagaattttatgtgtaggcttttgtggaagtgctagactgtttttcaaagcagctgtacccttatacattctcaccagcagtgtacaagggttccaatttctccacattctaaccaatatttgctattacttgtcttttttattatagccatcctagtggatgtgaagcagcacctcactgtggttttgatttggactttcctgttggctaataatgttgagcgtcttttcatgtgcttattggctcctttcacttctttaccttgactagtagactcgccttagatcagcggtttccaacctttttggcaccagggactggtttcatggaagaaaaattttccatgaggtgtggatgtgggggatagcgttagattctcataaggagtgcacaacctagatccgtcgcacgcagagtacacaacaggattcgtgctcctgtgagaatctaatgctgctgctgatctgacaggagatggaactcaggcagtaatgctcgcttgcccaccgctcacctactgctgtgttgcccagttcctaacaggccagggacaggtaccggtctgtggccctagggttagggactcctgccttagaggaatttggcccactactatagttatataatgacaggaaaatttcaacattctaatctctgtggacaggacagctcccagagtctgcacagaaagacctaggaaggcagcattgtgtttgaagttcggcacctgggacccagtattgctgaagcataaccccccggagtctacccctacagccccagtgttgctgaggaaggcatccaaagagacttcgggaagggtagtcagagaatgcagagagcttcacagcaagcaccagccaggggcttagctggaccccaggtttctaggtgatcatcaggtagcatatactctgtgatcttctttcatcctccccatttattctctacagttttacagctaccggaacacactgtcacttttacattatggaaaagttgaaaatattcagctgatttctgagaaactgggcatatttctcattgaagaaccaataagaaaattttttgtcacatcaaagtagacataaatttccaggataaaccagatggtgagtttagagtgtcaacttagtaaggacaatatgcatttagaataaatactttaccaagtaggacagaataggctaggtctgggatgcttctaacatgagtctaagagttgaacagcttgtcatttttcaactcgtcgataaatgggaatggaattatttattctggaaacaccaacagagttgttcgtcaattgttgatgtagtgtaaaatgattttaatgcttgtggtctaagaaagtatctctatcactcagtgcagtctaggacaaataaacaggcaaacaaacaggaaaacacaaattggaagataaataaaaggggcagcaggcagtgagtagttgttacctaatttgcattcaaagaatggtttaaagaatattggcaggaatccagtaaactagcttgagtcagatgaacttcatattaagaatgggtggaaatttataatattggggtttggctgatgctacaggattttcttggtcagaatcataaaaagatagagaagccatgctaattctgacactttgaaatgtaagagcagttcttgaggtattgaatctacatgaaagggatggaataaactggaaatgatttataccaacgagatttgagttaggggaatgtgttagttttctattgctgctataacaaattatcaccaactttgtggtttaaaacaacacaaagttattttatacagttcgaagttagaagtctaaaatgggttgttagggctgcattccttctggaagatccaagggagaatctatttctttttccagcaaaaaatgcaagactgcctacatccttggctcacggccccactccaccaatttctgcttccattctcacatatcttttcctcacattgctgtttctctatttctcttttaaggacccccatggttacattgggccagaataatccttcaaattcaagatccttaatttaattgcacctatgaagtcctttttggcatgtaaagcaacatattcacaggtttcaagtattagagtggggatatctttagggagctattattctatctaacacagggaaaaaaaggattttctcagtcctttaagtatcagcctgacggtgacagaaagtaagtgtttgttttctgagggctgagactgatcctgtagggcacagttaaaacatagtggttctgccctgaagtgtcatctgctgctgatgaaatcaaaggcttggatggcatagcttttccctgttagagtaagtaatcacagcattaataggtaggacatgatttaacccacagcatactaggagctctggccaacaactttaaaatgggtcttcaccatttggaggcatgattatgagctaaaaatactacgtgtaagatattgtggcctttgatttctacccttcaccaaaaatatcttgaggactttgtgccaggtgggtgctaggaaaaaaaaaaatgagacacagcctttgcagtctagaagccagcagccagttattacacataaaacacaagaacatattatataggaacaatagagtgaggtatggaaccagagagacggaacctagaaggatggtccaagaagtagaaagtgaagacagagtatagtggacccaagaataataataacaacagacagttatatggtgtttcctctaggctatgcactatctcagatctgtacacagatgctccttgacttatgatggggttatatttggataaacccattggaagttgaaaatagtggaagtcaaaaatgcattcaatactgtacacctaaattaccaaacatcatagctaaacctggcttaccggaaacatgctcagaacacttaaattagcctacggttggacaaaaatcactaagcacaatgtgcattttatgatgaagtgatgaatgtctcatgtaatctgttaaatactgtacaggaagtgaaaaccagaatggtcgtatgagtgctcaaagtacagtttctactgaatgcatgttgcttttgcataatcataaaattaaaaaaactgtaggtcaaaccatcataaattggggactatctgtatgtattaactcatttaatcctcataacccaagcctggtaaattggcttcccagatggggtttctcaaacacatctctattttccctcccagctgttaccactgtagttcaggacatcagggtcttttgccaaagcttcctatctagtgtccctgccctctactcttatcctacaccaaagtgatccatttataaagtaaatctaactgtgtgacttaaaacccttcaaatcttgctcagaagagagctgacatcctttaactctcatttgaagccctcaagtgtctgacctcagtcctcctctctgacctcacctccaccttctcttttccacccactctcatcagttacaatccagaaagagtggattccgcctcctggcaggcagctgtgctgtttcaggcccatggacctgcctccaccttttaccttcccccactcactaactcctgctgctgctcacatccctagcctgtgtgcggtgcccctcccctttcctcccacagtgacctgagcacagctcgggtatttatgcctctgttctccccggtaggtttaaagattctttagagcaaagatacagaattttcatcttcccttttccagcccttgtgcagtacctggcacataaaagccattcagccaatgtttgttaaattcagctaaactgagcaggaaacgtctcccttgtgtgtggctgtgcctttttgccattcagagagaggcagtacaatcatggtgatttgaggacacttaaaaatggaaagggctccacatcgaaggcctcttgaatatagtgaaaatgaatatcaaaatcaatatgccgttcagtttagggatatgaataaatgatttcaaatgaattcaattttcctctcaacattaagtggtgaaggaaaataaattattggataatgtatttgaagtaatagctctcttctaactgttcctacaatttgttgttacttgtctttggacctctgtgtgtcatgtgatactgtgtgtcatggcgatctgagaaatatttatctctcctcaccttctaaaggtcagagactgtatcttaggatccaagtttggaattatttcctgacattaatctcttcttcctctgtgctcccataacataatttcttctttttaaatggttgttttaaatagaaaaatgtcgtacttgaatattttgatttttatgggggaaaaatttactactatgaaaaaaatagaataaaactatgtgaaagaacgcctccatttctccttcaaacccacactgctgtccacaggtaatccctaataagagtctgttcctttttctatgcatgtatgcatccatgcatacaccatgtatttatgtgttgttttttgttgcttcttgttagtagataaaattaaaattatactctcagtattattctaccacttgagtttttttaagatgatacttctaaaacttttttattgacacattttataattacacatatttatggtgtacaatttgatattttgatacacatatgttgtataatgatcaaatcaaggtgtttagtgtatccatcacttcacagtggtggaacattcaaaagcttctcttctagatatttggtaatacacaataccatcctattaacaattgtcacctactgtgcaatagaacaccaggacttattcctcctgtctaattgtaactttgtacccgttgaccagcctctctctatcctcccttcttgctcctctccctaatctctggtaaccactgttttactctctgcttctattatatcaactctttatttatatacacacaaacacacacactttttttcttttcgataacagccattctaaatggagcaaggtgatgatatcgcattgtggttttgatttgcatttccctgattattaatgctgtcaagcattttttcatgtgcctattggccatttgtgtgtctcactttttcttttgaaaaatatctatttaggtatattgggttttttttcttttgtttaagtccctaatatattctggatattaactccttgtcgaatgtatagtttacaaatattttctcccattctataggttgtctcttctctttgttaattgtttttcttgctgtgcaaaaccttttaagtttgacataattctatttgtctatttttgcttttgtgtcctatgcttttgaggtcttatttttaaaatccctgccatgcccaatgttgtaaagcattccccctatgttttcttctagtagtttcatagttatagactttacaattagcctttaatccatttagttggattttgcatgtggtgagaagtaagggtctagactcattcttctgctcgtggatatcctatttttccagcactgtttatttaaaacactgtcttttctataatgtgtattcttggcacctctgttgaaaataagttgaatgtagctaggtgaatttatttctgggctctctattgtgttccattgatctgtgtgtctgcttatatgttagtaccataatgtcttggtacttacagctttgtaatctattttaaagtcaggtagtgtgatgcctccagctttgttctttttgttcaggattgctttagctatgtcgggccttttgtggttccatataaatgttaggattttctttttctatttctttattttgataagaatttggtattttggtattttggtatttggtgttttgataagaattgcattacatctgtggataactttgggtagtatggacattttaacaatatcaattcttctaatctataaatatgtgatatctttccatttacttgtgtcttcctctatttctttcctcagcgttttatagttttcagtgtagagatctatcacttccttagttaagtttattcctagacatcttaatttttggaaactattgtaaatggaattgttttcctgaattctttttcagatagttggcttctagcatacagaaatgctactgatttttttgtatgttgatttagtgtgctgtgacttcactgaattcatttattagttttaacagttttgttgtggaatctttagggttttctatacataaaatcatgtcatttgtaaatgggaatagtttgactttcttgtttccaaattgcatgccttttatttcttcctcttgactagttgctctggcaagcacattcagtattgtgttgtgggtttgtcatatgtggcctttcctgtgttgaggtacataccttttatacttaatttgtggagagtttttatcacgaagggtgttgaatattgccagaagctttttctccatttatttaaatgatcatatggtttttttcctcttactttttgttaatgtggttgtatggtttggatatggtttgtttgtccctaccaaaggtcatgttgaaattggatccccagtgtggcagcactggaaagtggggcctagtggtaggggtgttttggttatgggacagatctctcatgaatgacttggttctattctcagtgagttctcactctctcaggagtggactggttcttgcagaaatggataagttccagtgagagtgggttgtcataatgccaggatgcccctcaggattccctctctttacacacatatgctcttcctttgactttccctgccatgttgtgacgcagcaaaagcccttgcaaaagccaagcatgcttttgaacttctcagcttgcagaactatgagctaaataaaccttttttctttataaattacccagtctctggtattctcttattacaacaccaaataaactaagacagtggtgtgtcacatttgttgatttgcatatgttgaaccattcttgcatctctgggataaattccacttgaacacagtaattgatctttttaatatgctactatattctgtttgctagtttcatgttgagaatttttatgtctatgtttatcaggaatattggactttagttttctttttttgttgtgtccttgtgtggctttggaatcagggtaatgctgcctcataaaattagtttggaagtatttcctagtcttctattttctggaatagtgtgacaagcatcagtattgttctttaaatgtttgatagaattcagcagtgaagccatcaggctgggctttgtattttattttttgatggagggtattttattactgattcaatttcctcactcatcattgatctgtccaaattttcagtttcttcataatttaatcttacaatccttcgtatttctgtgatgtcagttgtagtgtcaccttgttcatctctgacttgaagttttgggatcttatcatattttttcatagactagctaaatgtttgtttattttatctttaaaaaaaccaactcttttgttgttttttttaattttttagtctctgtttatttctgctctgagctttattatttcctttcttctaccaattctggcttagtttcttcttgtttgtctattttcttgaggtgtttggttaagttatttatcaggaatcttccttattttttgatgtaggcatttattgctatgaactttcctcttagaactgtttttgctgtgttccataagttttggtatgatgtgtttccattctcatttgtctcaaggaatttttaaatttccctttcgtctacttacccagttggttactttggagcatgttatttaatttccatgtatttgtaagatttccaaagtttttctcgttgttgatttctaggtttgtaccattatggtctgaaaagatacttgatatgatctctatgttcttaaatttttaagtcttgttttgtagactgcagtatcatttatcctggatgttctattttcagttgagaagaatgtgcattctgtagctgttggatggaatgttttgtaaatacctgttaggttcatttagtctgtagtgtagtttaatatgatgtttctttgttgattttctgtctgtatgatctgttcattgttgacagtggagtgttaaagtccgatactattattgtattgctgtctatctctccctttagaactaataatacgtactttatatatctgagtgctccaagctggctgtgcaaccatggatgggcatgcatatgctggaaagctgcacagtgcctttctccagtaatgtagggctgacttcaagccagctgttgtgctggaaatgggtatgtgcaggccaagaggcctttctgatgtcaaattctttgagttatttttttaaaatgttacaatatgccttggagattatagatatacatacatacatgtatgtgtgtatacatatattatacatttccttcttttttctattgtttgcttttgatgagcatatgcttttcctgtttgcttttgtttggtttggcttaaactttttaaaataggtttttataattggcaattaaaaatatacttttttgctattaatgagtatatatgtctttcgtataaatgcaagcttttttacacaaaagatttctagaagtgagcttgctatgtcagaggatatttgcattttatattttgatagctacactctgacagatagcttcaaaaagaactgtgcttagataacatctgagcttgctcttttcaccacattttcaaaaatagtatcaacctttttcttatattctcaatctaatgagcaaaaagttactgtcttcttattttaatttttattccctctgctagtgagttaacaaacaaacacagcatatgtctcttagttcgtgtatattttctcttgtaaatggtcctttgttcagatttctattagcttgtctttatatttttttgaaagagctctgtataaaatgaatattaaacctttgtatattatagatgttatgactgtttcctcctagttatcttttaactttgttcactgtagctttttccacatggaaattaaaatatatgtatagtaaaatctttcagtcttataaaaattttttctaagtccttttatcattttctttttaaatttgatatctggtgagacagattccaattaattatggcataatttaaaaatttctttgggattcttgcctattttattgttccatataaaccaacaaattatctgtttaaattgattaataatcattaggattttgattgaaattttatctatagatttatatagaatcaatacattaaaatatggactctccccacccaagaacacaatatattgttttatatgttcaaggctttttgaatgtcttatcatacaattttttcatttttaatatagatcttacacatttttggtacctctatgtttatgtgttttaatgtcttattgttctagtcaatatgactttttaagtataattttaatgttttatttttgtcatatagtcaagctgatttttaaaattttatctaacttttatatagtttttcataaacttgtcaattttttatagattttatttattcttgcagagtcgccttttgctgtgattaatcaagccaaccttgattaattaaaccttttaaatttaaaccttttaaaggcttactgtaaattattgctgtgtttattttccacccttattaattatttccttcaactttgttttactttctttgttgtttattaagttgattatttaattattttcaacatttttgctattaattggtacatttttaaggctacttatttttcctttgagtttatctttgcagtagcctattttagtatatattcacagcgactcagtgattttaattttgaattcctcttacagtcaagatttattaaaattgagattttaaatgtatgcaattggagagttttcttgtcgttctttgtttttgcaggaaggaggtgttcatttttactatttatttatttagccagaaagtgtggaccataatttctactgttacaaatgtgtaaaattattttgtggccttatgtagtcaatcttttaaaatattctgtaactattaaaaataagtcatttttgtttgttggatataacttttaatattgaataatctatattgctgtttatttctgactacttcatatcattgatttataatttgtgtccaaatacaacagtgaacttgtttatttctccttataaaattttaataagttgaccttatatttttgatgcatgttgctaagtacctatgatgtattatcttaatattttttaattattttcatcttatactcaagtatatttatgattgataggaccagtcttgatttattagtgaatcttcatgttcgaccattctatgtcattttcatgtaattatgattctagtaaagagaatgtagctaaaattattatgtatatctgacatggcttctatttttaatgaggagttttacttaattcacatttgttgtaatgatcgaaatatttaatcatgtataacctgcttgtttatttttcttcttcttttgtattaagcttattttattagggtattttttcttcattctttctttagtaattctgcattccatttttctcacatcgtgtttgtttaaatacagtatgtaaacttacaatttccaattctatgttgacattaagtatgtcctaaaattgctctttctgaattagattctcagtaatttttcattttctttctacttccctgccccttcctgtgttttgttaaaatgatcatcaacatatatattcagcttatttgttctttaaagccattttcttaggaattatttcctggaaattgccctttaaagtgtcatttagtgggggcgcagtggctcatgcctgtaatcccagcactttgggaggccaaggcgggcggattactggaggtcagaagttcaagaccagcctgaccaacatggtgaaaccctgtctctactaaaaatacaaaaaaattagccaagcattgtgatgcacgcctatagcctagctactcaggaggctaaggcaggagaatcacttgaacccggaaggcagaggttgcagtgagccaagatcgtgccacgaaactctgtctggaaaaaaataaaataaaatgtatcacttagctttattatcaatactttttagacttaaaaacatgcattctggttaaattgttgaccgtctttccttgtatctcacagtgtcatctttttttagatttttttttgtttttcctcaaatatatcctcaaatattttcttcaaaagactcctattagataaagcttcctgagaccctgtgactgaaaatgttacctcagccttcacacattaaagataatttcaatgtaaaattctaggttaaaaattatgttttctcagaattttgaagacatgcttctacagtctctttgcatccacattttctgatgaagataatggtatcaatcagttccttgtttctttgcaaggaattattcactgcactgtccaaaacacagccacctagcacatatgtctcttgaacctttctttgaaatgtgagtagtagactgacgaactgaattttaaaatttcttaaattttaattaatttaaacttaaatgtaaatagccatgtgtagctagtgattagtgcagctctacatcacgaagatacgtatagttggttcattaatctttgtggatatgcagtatgggcattctccatgagttaattcatttttcatacttttcaaccctttgtcatctgtactcttttctaggagaatccctcattttaatcttctattttattattctagtttcaactattctgctgatttattaagtttatggtaattgtgcttttaatttccaaggattctgcccattaattttttatagcagccagttgcttttatcataaatatttatgaaaattttaaaaagtgtataaatatatataaatatatacatgcatgcatgcacacacactgtatgtatattttcatatatatttatacactttaaaaattatatatttttacacttatatacactgaagtgtatatatttttaaatatacactttaaaaaattaaatacatatttccattttatttctgtttcctctatattaactctcattttcttagtggttacctttttgcttgttgagtcagtgactcttttttcatactgtgattctatcaaatgtttagtaattgattatgtcttgatggaaaagtattgatagtgtcatcttatttactcagcacaaatgagaagtaatggtaaatacaggtactagtaacaggagccttcgttctatgtactagacaagggaagagagacacataaagggcccctctataaggataggtcatagcctcttgtattggcacaggagaccataagttatcagaggtacttctcagaattcccattttataaagctgtatttacagcataatcctagaagcaaacattgaggtcagctgctctgaggacagggaattggcatagtatacacacacataccatacacacacatacacacatacacacacacacacaataataaacatactggtccaaccacccatagttttctacttctagccttcactactacttctgatcttgtgcttatttgtggttcatctggaaaaaattacttactttggaggctcttttatctgcatggcttatagatttcagagacctggctaagttttttttttaattggttgcattgagatttagaattggtatatatcgtcctggtggacggacaccttatcactgtgatatgaccttgtttattccaagtaatgctttctgtttgactaatatcaatatagccataccagttttatttggtttgtaactacatggtacacagtaccactctactgttgtacacacatataaattttaaaaattagcttgaaaatattaatcttctacttgaattattttgtttgttaatgtacttattgatgtatttggatttatatccaccttattattatttagcctacctgatcttttttaaatgcctttggtttttctttcttttagattaatcaggtgatttgtcattcaatagtttattatcttattatttttacattttaaacaattcttttaatgcctaagagataaaaatatgtacccatgtcttattacagcttaattcaaatgattgctttcacctcttccacaataaggatacaaccttataacactttaacttcatttatccctttggtattattgtcatgtattttaattttatatatattttaaattccccaaacataaacattgttattttgtgccatatatatacagacatatatatatatatacacacacacacgcgcgtacatacatgcatatacacacacacacacaaacacacatggagaggaaaagaaggtgggagaaagggagggagattgatagagagcctcactatgttgctaagtgggcaactgagcttatctcaaaacttctgggctcaagcaaaccccctgccttagcttcttgaatagctgggattacagttgtgagccatggcacctggcttatattcacttatgtttacccaagtatttatctttgtattgctcttcattttttccttcatttctgcattttcctttatgattgattatgttatttatgaagaagaagttgacttaatatttcctttagtacagtcctaccaagaggaattgttttgatttttgtttttctggaaatattagtatttcatatttatttttgagatatattttcattgagtgtacaatgctagttgacatttatttttagcatttaaaaaatattccaggccaggcgtggtggctcacacctgtaatcctagcactttgggaggccgaggcaggtggattgcctgagctcaggagttcgagaccagcctgggcaacacggtgaaaccccgtctctactaaaatacaaaaaattagctggatgtggtggcatgcacctgtagtcccagctactcgggaggctgaggcaagagaattgcttgaactcaggaactcaggaggtggaggttgcagtgagctgggatcccaccactgcactccagcctgggtgcctgggtgacagagtgagactccatttctaaaaaaaaaaaaaaaaaacaccattctaatttcttctggcttatatcatttctactgagaagtcagctgtaatcttatttctgctccttcaaagatactgtgtattttttccttttgcttcttttatgatttattttacttctgtattttttaaaaatcagtttttctatgatatgccttaatggtttaaaaagtgtttattatgcttttagtttgctgatttttttgaatttatggattgatacttttcttcaatttggaaattttttttgccattatctcttcaaatatagtttctttccaattattttctctctttctgatatacaagttacatatatgtgatgcaatttctctttctctctattcttgcctcctccctttctttttctttctgtgtttccacttgggtcttttctattgactgtctttgagttcattaatcttgtcctcaactctgtccagcttggtactgtatgtatccatttagttcttattttaagacataacactttttatttctagaaatcccatctcattattttgtatagattctatggtggctttatattatgccaactaggttaggctgatctacatttctcacagttctttttcttccatgtttccaattgaagtgggtcatgaaagacatttcatgtgaaattcggaaggtggaattaaagcggtgatcagattaatttacacctggaaagtcatgaacagactcaaatgctgttgcagctcacacatgctgtcattgatctgttggttcacatcattggtgttgagcagcagacaggccttcagctactcctctttcagcttctcggaatcgttagccaaaggtgtgccaactgtatgacaaaggcttttaacttcttgtgcgcaaccattcccactgatggtagaagtagtgagaaactggaaggagcctaggtccatccccatgtgttccagtttattcctgtggattccagtttattctcactgacccaaccttgatatctgttctttttcctcaaatgtttaaccttgagacatgaacctccagtatcagatacaaaggcgtcaaccttaatgtgacttctaaccaactagatagaacatgactggttcagattttaattatctgataaaattctccaacattttatctttttgctgtataatttatctatttttcttattcatgttattcattttttttataatgtttgtcttaatatctacatcatgtgtggatttgtttctgttgcctatttctttttctcttgggttttggacccatggccctgtctcttgccatgcccaaaaggattttaataaatgcagaacactgagaataaagactacagaggctccagatgttgtgatcttgcattagaaaagggttaccctttcttctgccaggcagatagagaggctatcaccttaatttatccaggaataggctgactttagacatgctagaagttttgattaagattcagtctatctttggtttcctttgtctgtagtctggagatctctgtggcttgcaattaagacactacttcattcactagctcattcatcctagcaagtttttgtattctcagcactgggagagtacaaaatgtcccactccaccactcagggtttgtagcttagctctttagctccaccctgcacaccttcaatatttggcaaatattttgaggggaaaatcagttgtgtcttgagcctcttcaattctccaattttttgactccaatccttgtaaatgccaaaatgtctaatggtttctgtgtccccaacggtgcccccttgccatttgaaagcctactttcccagtctacccatgtcaagaatcagcacaatcttccagaaaaaaatgcagctgaagatcattattacacctgtccaatagccttcctttccaatgattttagcctctctaatacttattatctacaactatctattgcatacctttaaacagatgatttttgtgtttgttttgttttaaaaaaatcaacaggtaaatcaatctacttaaaactaatcttcatgcaacaaaaagcctgccaatctgttcttatttatatcaaactgaaatttctattagtttactgctctgctcttaggataaccagttccctagtcttaccatggcttttacaatcatattataatgtcttgtcagtagtaatttgagagggaagataggtgaacatgtcccttcaataagccatcttgaactagaacccccagggcattttgaaccttctgcctgtattacagttatctgattatatttgtctctactgctatgttatacatttcttaaaggtaaagactatatatgttatagttatctgattatatctgtctctactactatgatatacatttcttaaaggtaaagactttatgttattcatattcatgcttaccataatacttagcatatgtaatcatatatagtaggtattcatcatttatttattaaagaacttgtgaatagataactgcatgaagttcagagtcagtggctttcttggtatctttcacatgatgaatagtattgcttttaacaatccaaatattgtgtataatattatagaaatagaggcaaatatttcagttttttttttttttttacagaacgtggtatattctatgcccctaacaaaactcaagcaatattaaaaacaatttgcatctagcttctgggatttttgagagaattctttaaaaatgaaggactttaatcatctggtccctctagattttatagtagttgaagaaatatataaaaaaattttgtgatatatattttggttatctcctaacatttatatttccctttagaaaagaaaaaaatcccacatgaaaagggaaattgaagagaaatattacctaccacataaaaagtcatacttttgtaagattatatttccatttctacataatattctctcattatgaaatcatcagtgcattttttagtcataaacaagacagtgaaaagaaaatgagtaacaatataaatgactttctggaaaatgaggtctattcaaatttcaggaaaaaagttaactctgaagtattaattgatcataatgaggaggccaaacttcagatacacagaggagccatggaacatttcccataggcctgcagcttgtgaagacgtctaggaacactgacatgaagttaaatttaaaagtaaataaaaatagataagactatcagactgtcaacttgaagaacttcaacaaggaatgctatgctctggctttttgcaattcaaatatacagtaggaagaaacataatcccactaaaaaatacaattgccgtcattcttggccactagaaagaaatttcaaaaaggtcagcctctgctcctttcttccctaagaagtgaatcgatgatatagattatctcatgagcccatgaacagatgcccagttgttttggcagaatttcaaccctcgggagagaatcttaatctagtatctttctcactactggtacaagaggcaccaccactttctacaaacttcccaaccctgtttaatcttcacattctggtcttctcctttgacattccacctgaatattacatttttcattaaacaactatatatatgtgtgtgtatatgtatatatatatgtgtatatatgtgtatgtgtgtttgtgtgtgtgtgtgtgtgtgtatatatatatatatatatatatatatatatatatatgaccgttttgcagggactaagacaactcattcagtacagctcctccaaacaccaaatttttattaccaaatgcttcagatggacacctctttaatatgtacctgtcttaaaaatggaagcagactctcaagttccaaacttaagagcaaataccaaaaacaatgacaaactcagtggctgtgcaatacactgaccattcagaaagagaggcttgatctttcttcatcttacattgtcttctgaattcactaccattagattttggaagagcataaatttagaagaatgaagactcaccttccctacttcctttgcctatctctccaggacgacgatagaattttcccttctctctgacacttatcctgactatataatatgcaacactcccagatcttctcaatggactagtgaccacatcacttccattcctagcaccatttatcaaacagtgacctatggaatcaaagtttagcaaaattttttagaacctggcttaagaaaaccaaatcccttgtggttacaacttcaagttgtttcatgcccagagaatgagctacagtcctttccagatattcatgcctgaagctcattaataattttcttctctcagtaagtgaagacgaatcctttaatttgaagtggccttcacactaatgagtcatgtcataactctggaatcctttaagttgattttttatcttgttgactcagtgaggtagaaattaaggacagctcccattagctttatgtatttcttgaagcatctgctcatgatggcaaactgatccatcctaaatatttatttgcctataaatgccatggagtcaacacttcactttcagctactttctttctttcttttctaacccaaacataaaatttctttaaaagttctgtcaataacatcacttgcaatttaaacgctttaaaaatatgatcctttttgctgtgtttttgaatacttccttcatatttaattgctgtagacactttagttcctaattaaactgtattgtttatgatgttcggtctttaatagacatgataacaaaaaaagccagttgtagaaaattctctgattgttaattccagtcttaatcttaatactttccatagccagtgaactcatggggttgagaggagaatgggtagaaaatgagatacaaagcaaatacatagttcatgtttttgaggatttactagatgttctggaagacaagcttgaattagacttgaattgaattgaactctatgatttgtaggggagattagcttagaaatagtatctcaaccacttgcaagataaatatcctcctttgtcaagtctcttttcagcacatccccaggtttcgcgttggtgacagagaggagcatatattgcacacagaaagcttgcttcatcctcagagccctaaaatacttttattgtgagagaatggagacacttgatgaatctgatgggttctggtcatggaaagatttgctatgaaccattgcatcaaggttgaaatgcccaagaggctgacaagcttattgtccatttcaaagattaaatagttttggaaaaattttctcccctggcagttgtaattgtgtccatgaaataagtgttcattctgcttgagccctgtggtttgaatgcttccttctatatttccctccagtggattgattcaaaaaaagatttacttttttagacaatgcaaattaaccctgtgaacctgataacacctcccccaagtcctaacatccttgctgtgtcccatgctaataggcaatcagagacactgtcaagtctctttatcatggattatctttgtatctgtttgaagggagggaaaggaactgagaaatcattcttctaggttaataatgtggttctaggaaatggacaaaagctgccattaataaccttgagagccttgtgctgccagaatagcactcatgagttggtaaagtggccatttagttgtgggacttccaagacacctgaaaaggccttgattgtcccacataaactatagggaggataacgtctccaaaagaagaaagagggtatcagcagaaaaataaaatacaggctcatcataaagcaatcaactgttccctgactttgcccagggtcaacattacatattagtatgctacgtgctgacaaatatttgaccttttgagtgacttacagcatttctgtttctaacctggttaggtaaagatcattatgtgttaacacagaccacaacatattcctacttcacaggtaattatatctagaattcttaagtttatcattttacaatagcctcaatatcatgccttaaaattgaatgtgagaatatcaaagaagcctggggacagttaatggtatttacttctgagcattcactatgtccctggcactgggctaagcctgtgagtaattattttgtgtaatcctgtaacaattctatgaggtaggctctggggctatcctgtagaaactgacactgacactcagagagattgagacgcttgcctaaggtcacacagttagtaattcactgcatcagtttgaacccaggtcttcttcgggatcctggaattggagctcattcataactattgtcctgtactaccttcctgtactatctcaatcctcagtgtcctgagatagaaggataagctaatgctagaaagaagattctttactaaccagacgcatacatagtatgtcgactcttgttggatatgatttttgtgtcattctattattaataagaatagcttctaactgtttttgaaaatgtcgtttgtggctcgaaagcatcttaggatagtgtttgttgcccttgttcaggtactgttctctctccacatttttgggtcttcagaatgatcagcatccatgcctgaagtgaggcaatggtggtccacatatacgagtgagaaaacaacgagcaagaatatctttgttcaggtggctggcaaaatcagctcaccatagttctctagaaactatgagccaaataacaaggcaacattaaggaagctattaatatattgaacatgactgaagccatactagatattagcatcaagcagattcttttctgtgaaaagtagaaatagcagtgggaaacaggacttggaatataagtatgccaatatcatgaacactgacaactagaagcactttttaattaatggaaatgaccattgctgatatcccaagtgatctgtgtgcaggcatcacctgttgaagatgaagatgaaggctgattggtgttttcttacatttccaccagtcagaagtgaataataattgttatatgaatattgtatgctgaaattcatgtgttgaagacaaacctccgcagagccagaggattttctttcaccttcactgcccacaagtctctgtcattcttggctgcacgtgtttccttgcttgatttatctaattattttcttccttctttagtcgaccaagtatttagataccagatggtagggagatcagaagcaggaaccttttctgtctcacatggatgttgtagggattaatgaactaacatattctaaaatgattttaaaaggtgaagtgctatataagtgtcaagcatgattaactagcagccaagttattaggcacctgaatattatgcatcttttctgaatttcagaaaaatggatgtacatattaattttcaacagcactgttatttgaatgatattcatacactcaaataaaagtttagcccaatcccaattatctctacttttctcataccagtcatgtaggccttaaggatggaatatgtatgcaactttgagtaatacagacacaattaccaatcttgtggcgtttttagtgcctcaaggaaaagatacacagtaaaatgcaaaatattacaggaagattgagggacagcaatgagtatgaactgtagctcagaccctctggttccaaactctggtttaaccactagttctgtgactttgggcaaattgttttacctctctttgcattagttatttatgcaaacattggggtggatgatagtacctacttcatagctcatacatataaaatgctcacaaaagcagttcctcacatgcagtgattgctccttaaatattaactattatcattataattgtcactaacactggccttggctggtttcaccctctgagagcgttaataaataagatgtgtagttacttggctaggattcatgtataacttttagtagtttacaaagcccagttacttataatcctaacctatgattattcaacacttgcttgtgccagaatccacaaacctcggtgaaataggttagcaaaatggtagcttttatttttgccttatttgctcagcaaggtttttatttccgttcttctggtaatacactctaaccactaccttttatcccaggtacaggggcggacaaaacttcatacctgattaatcgtagtacttcttaacctaaggcaaacatgtaaaccagcagggctgacctgaggccccctctgacatactaagtaaggatttgatttgaaataaataaaaatagccttgcctaggggttcattatacttgaaaaatgtgagattggggttaaaactgaccacgttcattgccacatgaagaaagtccagctatagtaaaaaagaatgaagccgaacagagctgagctgagctgagagatggaaaagggagagagttctcttagctttgagttttgatcctagcaattgagaccttgatccctatcctttgatttggtcagatagcacagtatcccttccagccatgtgagccaataaatgttttctttttgtttactttaaaatagtttgaactgggtttctgtctcttgaaacttaaaggatccttacaaaacaaatgctataattcacccatttcgtggataagggaattgaggcttagagagattaagtgacttgctcatggtaacataaccagtgatttttcagagccagaacttcataccctatttaatgactccaaatgctatattctagtcaagacaacaaggccagggagctgggagatggagctggtcattaatgaaaggggcagagaagttatagggcaccatcaaattgtggctatcctcgtagctaattcatgcactggttcatcacatatttgttctaaatatgtgatgcacaaagaaaagaaaatctaaggccagttgtttagatagagaaagtgagtgatctgcaggtaccctcaaccctcaagggtggctgtctgctgtcagctgctgttacccagcaaggggtgagaagccacagagccagcctactcgtgtctccaagttgctattccagtgaatgcaatgtatgcagaacatgtcaaactcttgggccgctcagaaaattgattatggagcttgccccttccttaaaaagcaggcttttgtttttattagcatgtgtaaatatggaataacttctaaatgcaaatatggatgacatttgatttttctgacatgtttggaagcagcctggggcaaggtggcagtgaatcagtaaacatcacgggaactacactgggaatgtatcaactgtgcatactattaatgggtttatgccatatgttccataataacatgtttgctaacatgggattggactgcctggttgtatgacaaagctgccacgtcagttttctgatgtatagaaactgagtctgttagccagatatagaaatctagcaaggtcattttaggagtaatttccattttgtgtgcttttttccccctcattgactgtaagagaatgtgatttgcctcattacaatacaattccaggtacaaaatacaataatgacctttatgccaaagactgaagttcatgtaattgataaaatagactcagttctgcagtgttggaaaccattagctggaggcaggaaccgtgttaacttcatgacgtgggaggtcaaaggtcaaggtaaaggcccaggctgcaccacttctggactcagaaagaggaaaacagggctgcccagcaacattggagtttgcggcgctccctaggtgtgtcagagacatcctggggcatgtggaaagtgaaggaaaggcctgttattaaggtgagggtcaaaaagaaactagccaaacacagctgcacagtaacagactggaacaatgggccttatgaagcagggatactgggatagctgtcgctccatttgtcttctctttactgacttcatctgcttcatatctgaccccaaattatactgcccatttggaggcattgcttctttttcctctcctggattcttgattgttggtgctctggtgagaaaccagaaatgtcttatgaaatctttatagctacgtaggaaacttgagcctgccattttcacccacccagggaaggtatttgcctcccgaaaccgtagggtggcctgacatctgctttttattgaaagtagccaaacaaatcacgtccaccatgtggtgattatgacaagtgtattgattgacattttatgaaacatgcatttacaaatggcatctgaataccgaatgccactacggaccttaggactcttcctcaggcagcttggtcggagtgagatattgccagcattcattctccccttcactctgattccactctgattgagagtgcattgtttaatatcccctacgaacgacaacaacccaaacgtaacatagaaatcgggagtgaaaagggactgtgaagagtcacatactatatgaaacttgcagcttataaagagagaattaagaaagaaccagaaatgtatatatttggtcagaaggaaagagaagtgtgaacttaagggtattaagcagaggaaactgcctaaaatgataaataaaatggttagttcagttgtttctttacatccctggagttataagtatctccatctgaccatgagttaatggtattgggtatatttactgttgtatgattttcagagcttctagcccaaaactggagacaaaagctctatgttctaccaatgctcacagatgaataatgctttttttaaaaatatcaccaattctgctgtcatttcagacctcagagactctgcttattaggataggaggcaagcaaagaaatgaggtgggcatagaggtggcaggggttaatttcatatttatcatgagatcttgcatgatttccctaaaagatatttaatttccactgggcataataacttgcagctgccagaatgtgctgtgtaccagtggcgagttcttgtctttggagacttatgcaagtcattatttaaaaatagagatccgggagttacagctggctaattaatctaccactaaggaaagctaagcgagtgacccacttaactgctttcaggaaccatggctactctgaagcaaacttttgaaaaagtcctgtacaaagaaccaaactgatacatcctcatggcactgtcgtggtcttctcagggaacatgttccttctccatctgctcctcattcccacaaacaaacaccactaattcagacccttatccatacacatgtgaacgtccacagtgtgggttcccagatactttgccttttgggtccttctttctgaggttgctgccagtctcttattcttctctttttcctacatcacccgcctgctcaggaaccccgcttcagtccatgttccctattacttccactctgaggcttctgcctgtcttctgaggattcccctaagagactcacaccacatagttacccatatttcttccattccctccactgcacctttccctccaggcagaacaggtctctgccctctcatcctgtccccttacccagaccacctttcccattcctctctcagcctgaatatggtccgtacatcctgcaaagctctactgtatctatcccaggatatttttccttggacttgatagcagatggttgacataatcaaatcatgacacattttcatcattggtctgtgaggaccctaaccttattcttcagtaagtctattgatatatttattatttttcttcctactcctttccccctccctgcagaggcaggcattctattatattttatatacaccttttttattgcacacacccttgtcaaaaaattattgtcatacgtatatgtattttaatttccataaatgacatgtgttaaatttcatctgttttttactttatttacccagtcctatatcttttttcttttttttgagacagagtctcactctgttgcccaggctggagtgcagtgccgtgatcttgactcactgcaacctccacctcctgggttcgagtgatcctcctgcctcagcctcctgagtagctgggactacaggcacccaccaccactgccggctaatttttgtatttttagtagagacagggttttaccatgttggccagactggtctcaaactcctgacttcaagtgatccacccgcctcaacctcccaaagtgctgggataacaggcttgaaccaccatgcctggcccagtcctatacctttaaagtccatccatgtctctaatactccatggtaggcaaccaccacctttaactcttcgctgtcttcataatgtacacatcgagatccctctcaccccctgtaactccccttctctaaaatcccctggccttcatttactataaactagactcttaattatatgctgttttgtattttcctaggaagggtttatgtttctcccttgtctctcatgtaattcctttgagatcagagaccacctcctatactctttcctttcctactccacccaacactacttctgtagatgttctttggagctctgtgcataattgatattcaataaatcattgtttattcagtgaactgaatagtgtaactccatgaaggtaggtatttttctttgttcataaccatatctccagtgtctaaattgtacatggcatgtcataggtgatcaggtaataggcttgaagaaaatgattgtctcacctttcacataagaaagggttatggaataatagattatacaggggtcaggatacctatgttctagtttctagtttgctgccaactagattgtgtgacactgagcacatcaggtatcttctctggatcttggtttgactgaattatttctcatatccttttccaatctaacttgctaagactgattttattaacaatttttcaacatgaaataaaataatcttcaatgtaaaatcatctctagagatagaataatcatactcaaggcagtagggcatgggatacacagggttagggaaagagatgagaaaacatcctatggttccaatctttcgctttcagaatgattggtacaacaaaatgaactactacctgtaaagagcttagaaaagttcctggcacacaataagtcctaaatagtgtctactattatttttataaacttaagaaattctactagcctttatgataatattttacctggcatttggaagttatcacagttataaaccaaacaataccaggaattctagtatcactactgaaattaataggtttctttgatgggacagtaatcacaagacacattctgatttctttaagtataaatatttttttccccaggtaatggacaagttctaattctcatggtttttataaggtgaagtaaaggaatattgtccttcaagatcagttagcagccaagaatgatatttgggccagaatcctgagttctatatttgcaatctattttaaaaaatgactatttctactatagagcagtcacttaaaaatggaaacagaatagagctgtgaatttattaatatcatatgaggatgctatttttccctttggtaaggaagtagtaactaaataacctaatctagtttctcttatcctcagggaagtgaatccaaatattggataaaccattattaaaattctaaacagcatttaaagcatgagcttgtttgttgctataaggctattttttttttctctaggtcgagaggtaaagttatttgtcttaaagaaaaaatcattaaatggtattggtaatgggctgcaggttttataacttaactatatttgcttcacgagcaaaaatagcatttgatggctattttattctactcttcttgggcaaaagaaatcttaatcaaacatcatttcagtttaatgcttttacatgcaaaattcaatttgtgaatttatctgctatctaaatgttaagataaaataagatagaaatacaaaataaggactggagactccatataagctagaaatttttggacaaaggaaggattacaacttctactcaaagggtttgagaaacaggtagataaaatatctagttaccaataacgacctaggaaaatgatcacaattcagttgttttagagctcacaaacactggagtaaattataatacttacatgatgtcttagtctgttctcacactgctatgaagaaatacctgaggctgggtaatttataaaggaaagagatttaattgactcacagttcagcatggctggggaggcctcaagaaacttacaatcatggtggaaggggaagcaaacatatccttcacatggtgtcaagaaggagaagtgcaaagcaaaagctccatataaaaccatcagatctcatgagaactcactcaacatcatgagaacagcatgttggaaacctcccccatgattcaatcatctccacattgtcactcccccaacatgtggtgaccacagttcgtattacaattcaagatgagatttgggtggggacacagagccagaccatatcacatggtgaaatggaaagcaaaaaaaaaaaaaaaaaaaaaagcaggggttgtaatcctagtctctgacaaaactgactttaaaccaacaaagatcaaaaaagacaaagaagagcattacataaaagggaacaattcaacaagaagagctaactattctaaatatatatgcacccaatagaggagcatccagattcataaaacaagttcttggagacctacaaagagacttagactcccacacactaaatagtgggagacttttacaccccactgtcaatattagacagatcaacgagtcagaaaattaacaaggatattcaggactcgaactcagctctggatcaagtggacccaataggtatctacagaactctccacgccaaattaacagactatacgttcttctcagtgccacatggcacttattctaaaatcaaccacataattggaagtaaaacactctgcaacaaatgcaaaaaaactgaaattgtaacaaacagtctctcagaccacagtgcaatcaaattagaactcaagaataagaaactcactcaaaaccacaaaattacatggaaatttgaatgactcctgattaaataaggaaattaagacagagataaataatttctttaaaaccaataaaaacaaagagacaatgtaccagaatctctgcgacatagctaaagcagtgttaagcgggaaatttatagtactaaatgcccatatcagaaagctaaaaagatctcaaattgacaccctaccatcacaattaaaagagctagagaggcaagagcaaactaaccctagcagaaaacaagaagtaactaagatcagagcagaattgaatgagatagagacatgaaaaaccctccaaaaatcaatgaatccaggagctgcttttttgaaaaaatgaacaaaatagaccattagataaactaataaagaggaaaagagagaagaatcaaataaataatgatacaatattgtgtaccatcattttacatttccatataaaagcgttaaacacaataagaaatgataaagaggatgtcaccactgatcccacagaaatgcaaactaccatcagaggatactataaatacctctgtgcaaattaactagaaaatacagtagaaaaggctaaattcctagacacatacaccctcccaagactaaaccaggaggaagtcaaatctctgaatagaccaattacaagttctgaaattggggcagtaattaatagcctaccaaccaaaaaaaagaccatgaccagatggattcacagccgaattctaccagaagtacaaagaggagctggtaccattccttctgaaactatcttaaacaattgaaaaggagggactcctccctaattcattttatgaagccagcatcatcctgataccaagacagggaagaagcacaacaaaaagagaaaatttcaggccaatatccgtgatgaacatcgacacaaaaatcctcaataaaatactggcaaaccgagtccagcagtacatcagaaaatttatctgctatgatcaagtcagcttcatccctgggatgcaagtctggttcaatgtacacaaatcgataaacgtaatccatcacataaacagaaccaaagacaaaaaccacattattatctcaatagatggagaaaaggtatttgataaaattcaacatgacttcatgttaaaaactctcaataaactaggtattgatggaacatatctcaaaataataagagctattcatgacaaacccacagccaatatcatattgaatgggcaaaaactggaagcattccttttgcaaaccagtacaagacaaggatgccctctctcaccactcctattcaacatagtactggaagttctggccagggcaatcaggcaacagaaggaaataaatcatattcaaataggaagagaggaaatcaaattatctctgtttgcagatgacatgattttatatttagaaaaccccatcatatcagccccaaaactctttaaactgataagcaatttcagcagtctgaggatacagaatcaatgtgcaaaaatcacatgcattccttacaccaacagtagacaaccagagtgccaaatcatgaatgaactcccattcacaatcactacaaagagagtacaatacctaggaatatagctaacacggtatgtgaaggacctcatcaaggagaactacaaaacactgctcaaggaaataagagaggacacaaacaaatggaaaaacattccctcctcatgggtaggaagaatcggtatcacaaaaaggccatactgcccaaagtaatttatagattcaatgctattcccattaaattaccattgatgttcttcatcgaatgagaaaatactactttaaatttcatgtggaatcaaagaagaccctacatagccaagacaatttcaagcaaaaagaacaaagctggaggcatcatgctacctgacctcaaactatactacaaggctaccataaccaaaacagcatggtactagaccaaaacagacatatagaccaagggaacagaacagagacctcagaaataacaccacacatctacaaccatctgatctttgacaaacctgacaaaaacaagcaatggggaaatgatctcctattcaataaatggtgctgggaaaactggctagccatatgcagaaaactgaaactggactccttcgttacactttattcaaaaattaactcaagatggattaaagacttaaatgtaaaaccccaaaccataaaaaccttagaagaaaacctaggcaataccattcaggacataggcatgggcaaagacttcatgataaaaatgccaaaagcaatggtaacaaaagccaaaattgacaaatgggatctaattaaactaaagagcttctgcacagcaaaagaaactattgtcagcgtgaacaggcaacctgcaccatgggagaaaatttttgcagtctacccatctgacaaaggtctaatatccagaatttactaggaacttaaatttgcaagaaaaaaaaaccccatcgaaaagtgggcaaaggatatgaacagacacttctcaaaagaagacatttatgcagccaacaaacaggaaaaaaatctccacatcaatgatcatcagagaaatgcaaatcaaaaccacaatgagataccatctcacatctgtcagaatggtgattattaaaaagtcaagaaacaatagatgttggtgaggctgaggagaaataagaatgcttttacactgttggtgggaatgcaaattagttcaaccactgtggaagacagtatggtgattcctcaaggatctagaaccagaaataccatttgacctaacaatcccattactgcgtatgtatccaaaggaatataaattattctgctgtaaagatgcatgcacatatatgtttactgcagcactatttataatagcaaagacatggaaccaacccaaatgtccatcagtgatagactggatagaaaaaatgtggtacatatacactatggaatactatgcagccataaaaaatactgagatcatttcctttgcagggacatggatgaagctggaagccttcatctccagcaaactaacacaggaacagaaaaccaaacaccacacgttctcactcataagtgggagttgaacaatgagaacatatggacacaaagaggggaacaacacacactagggcctgttggggagtggggggtgaggtgagggaacttagaggacggatcaatagggtcagcaaaccatcatgacacactatacctatgtaacaaggctgcatcttctgcacatgtatcccatttttattaaaagaaataaaaacaagcattaaaaatggaaatttgtttttaatcataaatttaattttggggagtaccatagtcttctattaagataaaaatgggctatattctaataatgttattctgtgttgtggggctatattatcacaatagttcttagctgaagctgccgttttttcttatatggtataaattgtgataaaataagcattttgaacacccatggagtgttgccattaattaaagaagataatatttagaaaggcaatttgaaaaatctcaagtcctatacacatttgcttctgttattattttattcaatacaaatcacaaaagtgcctattgtgtaccagaaactgctttaggcacttgaacatttatggagaaataataacactgacctttgcctttaaggatttcataatgttggggaaaccaatatgtaaacagagaatgccaatgtaatgtggtaagtgtgatgatagatacatgccaaggtgcttgggagcatagaaagggacccctaagtaagtttttagagtcagagagttcagaggaggttagagaaaatacaggaagggagtttcagaggaggaggtggcaagaatgtagccttcaggtgaaaaatagcatagtatattctgagcagtaaagagatcagcattcctagagcttaaaatattgagcagagaaagcagaagatgagtctctagaagtcggattacagaaggtctgtctattatgttaaaggttcagatttatctgcttggtgatgaaaagtaaggaaacaatggggtccctccgggggagtatggaacgtggatccaagggtcagagagaacagtgaagagggtattgctgaagtctaggggaaagagccttcagttattcatgtttccatgctgtttcttagaggctcagcccaagtatctgatctttcccgcatctatgcataagttttctcaagcagtgctggtgatctccacaccgcatcttcctcctaaaatatttactgattatctgcattcaagtatgttataaactattttaatttgagatataaatattagtcatgcagctaactgcacccacctttccaggagcatctgctttttgtgacagacactgtggctttcaagggccttgccttattacttattacttattgcaccccactattcaacctgtcttcctactgcactaatatgcaccctgtgctgcagtcatgcagaagtcttcactgttctagaaaatgaagcacatgctgtgtgtatcacatggctggagtaatcatttggacagtgaagattttctgaggtgtccccatcatctcgtcacacctgttgcagaatgccacaggcagctctgtgaggcacgtgctgctgcttctgaaatgatgcattcccactcaattacctcattcattacaagttttcagctacagattaggagtactattcaccccttctgtcttagcagaatgttaggaacatttgaatcagtggtactttttaaaaaaaattagattttactgctgtttgctgtttactattacaatcacagaagtaaaggctaagccattttcttctttaaaaaatagtgttttccaatatgttcaaacaatctccaaatgaatagaagaaaaaaatgcccacagaagtttcttagactcactgtcatatctggatactttaatctcagatgttctggctcttcccaggctgataggatggctgggctaataatacaaataccttaagggctctgttctctactgagtctggacctagaatgtgcagctttaggattaggggtactagttttagagtcaaactgattcccttcctgattaccacttacaaactgtgagatgtctttagggtggttggagggattaaatgtgatcatctgcactgctagtatatagtaagggctcaaaaaatgaagcctgctatggaattatgactattaataattcatgctctaatttaagaaattgcctggtttaactagcctcaggcagaggctgggactgctttctcatcaggcctcagctacatggctacaatatagagaggttccttttcagatatgcacacacacttgcttctctcatcactgatgatgcttgctctctctagtcaattaatatgatccacctctcagggtaatcatttccctaaggaccaaatgtgcttacattcagttgcacccattgtaatgcaattaatttttccaataatatccatctaatagataggtacattataaaggagagccataataataagctacctcctgtttgctcattttgaagagactcattacggacaatggtcctcaatgttaatgaagtgacacaatccaattagaagattgcagttacacatggtagtggtagaatgagaggaattgctacctaacaggtaatgtcactgtttgtgccttgtttttgccctctgtggggttgtttctgctttggtccagatctcactctgtccttgggcctactttgggattctgccatcttctgaatgctggtaaatgcctaagctgtaaacagcttgcttttctgcagaacagctcatgcctgaaaaagttgataatgatttcaaaatttcttttaattgagtttttaattacaacacagatagcaaatagccctatcacatgtaattttgacaaagataacaagcaatttcatattctttggagaatgacagtgtgggagcctacagttaagtaccgactgccttgtttttagacaggaatatctgacaaccactcactcagggaaggtcgggaactggaacatctggatctcaataaattgttcaatataacaatccaagtgctataacacaagctgctactgggaatgtaaatctgactggctggtttaggatcttgtctttctaattaatagaccacgtattatgaattgggatactgtagagccagttggtgtatgggcatgccttcaccttaaataaatatttttatcttcagatcttatcacatcagaaaaaaatatgcagataaattattccaaaatgcaaagcttaaatttgatatgggtgccgtgtttcttcattacttttcttttattggcatttacttaagagttctagagccatgcccagagttccagaactccagagctaaaattagacaaagaaacttctccatctcagagagcagagaactcgcccacattagctgatctactggcacctcccacagactcacaaaggccatttgcataactcccatgcctcctagtaacatccaaaggctcaagccgatgtatctttttcaaccacagagcagtaattatcagacttttgcatttcaaaaacctggaaaacaaaaattcttcttaattcaagtcctacagagtggtcaacttcttattttgctaagtaaagatcattaatttttttccttttcactcatttgttaattcagtgaatatttattgagcacatactatctgcagctactaaagtatgtctgggaatgcgatgaaaatcaaagctagatatagcccatgacctcaagcatcatatagtctagtgggggagatagtcatcattaattaattacatttatatatatatatatatatatgaaatttaaattgagctacgtactctacaggaaatagacatggttctctgcaagcatgtaatatcatatattaattttatatggaaagagagtatcagggaaatattccccttaaaattaatgcttccactgaacaaatctcagactatgcaggccatggtaaggattttgagcttcatgttaagagtaataaaaagtaactaaggaattttaagcaggattgatgtttttaaagaattcctctggatgctattggggaatggattggaagaaaagcaagagtggaaggagtgagatcaattgaaatgacatttcagtggcctagatatgacctgtgtgatggccatggtgcaagtaactagttggatttaaaacatatcttgaaactagaatttttgagactctgacaaatgaagagagaagagagaaagagagaagtatcaaggatgattctcatattcctggcaagagcaacttgccatttaatacaccatttactgagctctaaagaccaagaaaggagcaggttaggggaggaagggggaatcagaggttccttttggggcttgttaaatttaaggtgcctatgaaatatccaaggcaggaagatacaggtgtcagaagattagaggaggattctgacgctagatatacatttaggagttatcagcgtatcgatggtatttaaagctatgggagtcaataacatttcacaggaataagcatgatggaagttataatatttttgaggcctgatacagaaggagaaatcttcagagcatctttccatgaaagggatcacattttaacacccacaaagtagaaagaacataatatcaattctttaatttaaggacatttagctgcatgaaatcctctctccattgtccttatctttctcattttgctgcagatcagtgagaactttgttataaaacagcagtggcaaaccactaccgtagcgtttctgcaactgccttaggcaggaattacctcattttggtagcagaaagtcttgtccacatccagcctcgcctcacctcttagattttccaagcttaaaacacatctggagattctgaatcaatttaggacggactaaaagtcacaaagtagcacagatcctacattatgacatccgttctgtcctatcctacattgcaaaatctgtgtctatgcattttgtagcattcctaagtcaggggactacattgcaaattgtaatattgttagtcatatatagggtcaaaaacacacttgcataaatatcgcctcttcctgccaatcacagtactgtcattcgtcgtagtattctttcctactgaacctaatataagtttccagatcctcctgttacagtgtccaagacagtcctaatcaaccaggttgaatatgggaggtaatagtaataataaaaataattatattatacttatagctgttataattaataacattttttgtactttgtctcatgcactgcactaagtgttgtctatgcctcaccttatgtaaacattaactgcaacttagaagattgctaagagatgaagaaacttttttttttttttttgagacggagtttcactcttgttgcccaggctggagtgcaatggcgcactctcagctcaccacagcctccgcctctcaggttcaagtgattctcctgcctcagcctcccgagtagctgggattacaggcatgcccccccacatccagctaatttttttgtatttttagtagagacagggtttctccatgttggtcaggctggtcgcaaactcctgacctcaggtgatccacccgcctcagccttccaaagtgctgggatcactggcgtgagccaccgcacttggcagaagaaacgttttacagatgaaaaaactgaggttgaacaatgagcatcccaggtgtacatttcattattgtttctacattgtgttgtaattatatgaaaagtacagattgagactctgtactttccaatttggaatcttaacacctaacagtgcttggcacatttaaggcacgtattaaatgttgaattatggaaggccttacatacgctatagtgatagaagcttttcaaatggaagtggttatgtcctgcgtgatttggaccctcttacagcacctagcataatactcaataagtatttggaaggttgagtatatggatttaaaattggctggaaaaattccagtaaactcagaggttttggagtgatggtgctagtagtgggatcactactgaagaaggataaagaagatgaacctcctaatatgctcttgccacaactgtgggtctgactcttatttaagcattcttattcatgacctggatggaaaaaaaaggaagaagctgctcctttttagaattcactaatgattctaatttggaaagtatcttgagcagctcgggcaacagaaataaaatgcaaatgacctttgagacatgaggtatgtaggctgggaataataactttgtgagcatttgaaaaaggcaaggcagtgaatacacctggggaaagagaatccaaacacagagctgttctgggaagcagatgccagatctcagtgatgccaaagtaggcccaggaggcacagtggttggcaaattaaattcaggccagccatgcagtctggcaggatgaaagagaagtccaggttgaggctgcctgtgcagaagggcacggaataacagttcctctgtggacagttgtagctgagcagcacctggcaccacacgttgtgttcccaccacttcattactagggaagctcaggcaatttggaagtgcagagaatagcaataagagtgaatgaattcaagagcccgaggaaggatgcggatgaaagattaaaaggattggatagctgtagtttagctacagaaagctaagggaagagaaaggagaggcctggaaactaataataaatatccaagtctgttctaaaatagccaagaagaaacttgcagagtaaccattaaattaagatttttcaattgaaaatggacattttcttccaagccataggcttcttgcctaaaccagcactctgcctacgcaggtgcttagtaaatactatcttatggaataacttttgtttgccaaaagagtatatgatctgggaactagaccaaccgaaaacacattaaaaaatcagacaacccattccttagcgccccgtgaggacaggattaaaggaactggatttttgttgtgttgttcaagtcatactcttcaacaatgaagttacctcttcccattcagacaaataaagaacaaaatagaaacctttgtagcacagggaatgcctaagacacggttgactaggctctggttaaatcccagtattgcaatttactttatgtcaaagggaacaagcaaaatgctaatgcctaccctctcagacaaaccttcctaggcaatggagggggtgtagaaaagggtgtactttctggactaatggtgtacttggtggacttcacttttaaatgatcaaccacttgggaggcggaggggagtggatcacaaggtcaggaatttgagaccagcctggccaacatagtgaaaccccatctctactaaaaatacaaaaaagtagctgggtgcggtggcaggtgcctgtactctcagctacttgggaggctgaggcaggagaatcacttgaacctgggaggaggcagaggttgcagtgagccaggatcgcgccactgcactgcactccagccccagcgacaatgcgagattctgtctcaaaaaaaaaaaaaaaaaaatcaaccacaaatatccaagtagataagttagaggtaatttcttgttttatagaaggagtctctataaacagccagctccccttgctttgagccattctttgtttacagatcattaaccacacctttcttaacttagtgcctgggtaagaaaataaagtattcagcttcccagccaattgcaaagccttcatagtgccattgttaagctccaggctcagagggcttcctcaaacaagccagacctttgaaacatactgctcctccctctgctggtcttgtttatcctcccacttctctgccccattcttgctttcttcctggctggctccctctcattcttttcctctcaacttaaatgtcccctcttctaaaaggccaccctatgtgtgtttatctgcttgggatgattttggctgcaaataagaggaaactgtatcgatagtggcccaggccagtagatattaattcacttgcttgaagtccataagcacatagttcagctctggtaccatggctcagcaatgcagtcaaggaccaggcagccttctagctctctgcttcatctcataccattggcttccatctttattatttcaatatatatgcttcaccccagcatcacttccatgccccaggcaggatgacatagcaggagttaagggagcataaagtctttcttacgtgaggcgttgttgcttttttcaggaaggagaatagtccccagagactcctaactatctctgattgattagaactgtgtcacgtgcaagatagtctgaaatatcatgattagctttccaacctctatagtaaaggaaggcaagggccaggggtctgtggatatcttttaggcagccaaacttcagtgtctgccatggtatatgcctctccctctcctaccccccatttaccctcagtcatggttccatatttttttctcttcatggcatttaccatgatttgtagttgtacattttaatcccactgggatagatatcttccatagctggctctgccgccactgtatccccagcctttagtgccctgtgcctgatgaatagcaggtacttaataaacatggtttgatttgtagcttagctggctgctagatgaaaagagaagagaagttatttctgaagttatcacacaatcacaacatcctggaaaaacaggattctggttatcaaaatttgatttacacatacatcctttgtatttattataccatgtttcaaatataaagagatgtatatatgaaataaaataacgaacactcaaattcccaccattcagctctatcaaatttacagattttgccataggcccttgaggtctgttgatactgttatattttaagaaacaaaacatctcaaatccaattgatgtccccgtgtcccttccctgtccgtgctcctgtctttctgtctccagaaataaccattaccctgaatttgagtttaccagtctagtatgcatttttatactatgactatatatgtacatagtcatagcaattacagggcattattttgcaggttttcaagctgttatataaatattatattttgtataaaattatatagattatataaatactaaaaatattattacctttttggtctatttgtttaactacatttttgcatatagctatgtagtgttttgttgtataaatataccacaatttatttttccatttttctgttgataaacattttgattgtttacagtcttcccctgtaataggtaatgccacatacaattaacattcttttacatatttttttttgtcacacatgtgagggtttcttagtctaagatatatacctagaagtaaatttacagggggaaggaggtaggattgctctgattttctttgattcggccaaagtgttctacaaaacagttgtgccaactgatgcttccacaagcagtggatgagagaagctgtttcaggtttcagcagttggtatcatcagacagatctgtatcaatcttttagtgtgaaatggcatcacatcattttattttgtgtttccctgacaatgaggaaggtcgaagatctttaaataggtatcttggccaatcaagttttgttttataaaaatttgtgtccatttcccttttagagggaatgggttttgttttcttattgatttatacagtactttatatattctggatagcaattctttgttgttaacatgcattgcaaatgtctttttccacactgttgctaggcttttcatgttgtttatgatgttgctttattaatagcagtattcaattttaatatcatacaatttatcaacctattactttgtggtttgggctttttatgtctcatataagaaaaccttcttcatttccaaaattctaaagattctaccatatttacttataaaagctttacagtttggctttctacaagtagtccagctggaatcattgttatataatataatgggctctaattttattttattttttgctgcataggtaactagtcatctcagcagcattattgaatgcttcattttttggtcactgattgattgataccaagtttgcatgtatgtgtgtgtctctttttggattctgtattatgcttcagtgttctatttttttccccatgacagtactactccttgattattcctgtagctttagagatattattgcatagggttaggtgtaggggcttagtagccatgctgcttgagtttgaatcctaacaatgccactgcctagccatgggatcttgaaagagttccataatctctttgtgtaccagtttcttttttatctgtaaaatggtgacaataatcatatctaacttataatggataaaaagcttttgcctgttttttgttttgttttgttttttgagacggagttttgctcttgtcacccaggctggaatgcaatggagcgatctcagttcggttcactgcaacctctgcctcccgggttcaagcgattttcctgtcacagcctcccgagtagctgggattacagcacctgccaccacacccagctaatttaatttttgtagttttagtaaagacagggtttcaccacgtttgccagtctggtcttgaactcctgatctcaggtgatctgcacccccgccctgcctgcaccggcttgccaaagtgctaggattacaggtgtgagccactgtgcctggccttgcctggtattttaataaaccttaaaagttagcagttttagtcatagtgtgagtatcagcattattattactaattgtgatatctgataggtcaggtcacttctaccctttcttcttctccaaaatggtcttaaacattgttgaccttttgctctttcacatgaatttcaagatcagcttatagtgcttcatgacaaagttgattgaaaacacaaatgtcattgcattgacatatggattaatttgattctccttatccgtaaacttgacataactttgtttattcagctcttttatgccaattagaaagtaattttgtaatttattccacagaggcccacacatgtttcttagaattatttttagctgcattgcagtttgttgttgctattgtgaataagatttttttcatcttattaattattattattacagcttggattctggtgtcaatgccatgttcttttttattgatacataatatttgcacatatttattcagtccatgtgatattttgttgcattcatagcatgtgcaattattaagtcaaggtatttggagtatccatcacctagaatttttactatttctgtgtgttggtaacatttcaagtcctttcttctaggtgttttgaaatttacgatacatttttgtaaactatagtcatcatactctgctgtcatatattagagcttatttcttctatttcactgtatgcttgtattcattaaccaacctctcttcatacccctcccaacccccaccacacacacacttcacagcctctggtaactatcattccactctgtacctccatgaggtcaacattttcagttgcatgtcagctccactgttgggggcagtggggtcactgccaatggttcatgctttggccctggtgacagcagccaggagcagcagctgctgcaggtgggggaggtcaatgggtttccaagggtgtggatatgcagagactgttgcaccctagggcaagatgcagtgtagcggaggctgggctctaaaaatggcaccttgctgtagctagttaggacttggggtatgtgtgggacccaatgtgagctccctctctggagcaatgctgtcatgtggattccaggcagctccctatgttagtctcagggcccacaaagatcaagggactctctcacggctaggattgctggagtctgtggtgggaatgtggaccactgagggtctctcacttaccctttcccccacattggagagcttttgcaggctctgagctgctccctactgaattggatgcctcacttccctcttcctttgctttcctttcacttttctgctgaattccagtgtcctctcttagatgacttacttgaagtgtgattatctgttcactcttttggctcctctttgtggaggaggtgagtaccagatacctctagtcagccatcttgaagcccctcagcgttattattcttgaatgagttgttactgctctgtagaaattctgttgttacctttatgttgatcatgtatctggccaccttgctgaacactgactaatgtttatggtctgcagattcccatgaattatttatgtaaacaaaccatttatgctttaatatagctttgtttctgtctttctaatatgtgcctcatatttatttttatttttcttttcttaaaatgttgactaagaactcctaacagcattaaagaggagtattgatagcaggcatccttatcttattctaaccctaatggtaactttatgttgcattattaggtttgattcttgctatcggtttttggtagataatatttatcaagtttagaaagttaccttttatttctagtttacaaagatttttagacataaaagaatgttaaatttcatgaaatattttttggagtctcttgagtttatcatggattatctatttttaatttgttattattgggtagtactttaatagattttctaatgttgaaacatctttttatcctaggataataatacacattggtaatcaatagtgtttcaaagaaatacttgggtcttttcccaaaggacaaaaaacctgaaggtttcaagcaattactttgatttgattttacataagttgtttttagatctttgtaggtaccattcctttatctctgtcatcttttggcatttatttattttttaatatggagcatgtaaaacgtgtataatagtaacaaaagatatgaacagtgggagatgaggaaggtggaaatgttagctctacttattttggaccacaaaatgagggttgctagaatctcctctgaagtactggatttgaaaatcgatcagccaagaatttctggagtcactcaggcccgtgccatataattacattatttgctgaggaggttaatcaggctggccatttgtctaaagacctggtgacacctatatccaaaattattttcaaaacgagcccttaactgccccgcataactgggtcctgcttgtgagctgcaagggcttgacttcttaggagttgtcctgtgtggcactgatgatacctggtgatggaaaatgtgtctgctcttattcccttacagccactttgttttctctctatttttactcgtctttagtaattacatgatttttgagactaacatacatgtaaaaccttttgtagatctgatgctaagcaaagaaacgatgttctgctcaataagtagagtttccatcttacaaaattatttcagtgcaattgcttttggtggtaaaatgccaagcattgtagaaatatgattttgatggtggttgagcagtactgtttctgtctaattacactcacgtattcatacaattactgtgaaattactgtaccaaaagcagtatatacacatagtaataataatgcaatgttctgattggctggctttttaaaagatttcagaaattgattaaaacatttaatggttcttctttcaagtatttgtgaaccaaatttcttattccaattgaaaatatgttacaaagagaatattcatttctccttcccccttcatcatgtagaacatagggagaaagatacggaactcctgggagttatctccttgattaactatgaagtaataaacagaagaaaacagcaacaattcatgtagttgggtactaaatctacacctttatggcctgcatttgccaactgtctccatatttgacagataaagtgcatctgtgaattttaagtctctcgggttatagttaagatatgtaattagagttccagatatacatcttacctaaaaacttctgctatggggaggggagaaaccaattaagtcagttttactcagcttcaaaaaaaacccctcaacctgaaaactgatgaaataactaatgaggacacttcatgtggggcatgttatttcttgatagagcaagtgtgttctgggacagaggctcttctttccctgaaggctggagtcaggaggtttacttggttaataaaaccacctccttgagacatgtgacttgatgtgtgtgtggtggagggggtagaaactagtatttttgaacatttgttatatatagtttcctaagcatttatacttatcagaagaaagttagctatctgagaaactctattaacttaaacaggccaatgaagagctgcttcaatgcactgaagcacaaatgcattacaatccctgggctgctgaggactaattccagactagaaacacttctaataattctaatgactataatgacaaaaagtaactaatatttcctgagcagatagtacatgcaagacttactaaatgttaagtaagtgttaacttatttaatattcaagaaaaacacatggtaggtaataggtcattaatagttagaaactgaggttcaaaacagttaactaatttgcccaaggtactataaatatctcctttgataggttaaatcatttttcttctgtaaaatggaaacagaccagttgattattgccatttataaaatagccttaatgcccttaaaaataaaaactcccttgaataatatatgaggagaaggcaggaagatgctagaaatgtcagcttattagagtaagtatgtattatattgttaacagccaccaaaaattcacatagaaagaagttactagagatcttcaggaagattacaatctaatcagacagataaaacacacacacaagaaattacttgaaataattaaataataaaatgtcaacaaatgcaaagtagatacataattggaattgaattctagtttctgtggaattaatatcattaaatcagatacaaaatgatggggcagggagagagtgggtgactccttctcttaaaggattcttcctgctttcaacataagctggtgattccaatgagtgcatgaggacaaatcaatgtgaagggcccaggaaatgctgactgatccaaacaaagtgaacctggtcattaatgttctcctaaaggtgagatttgagattcaaagaaggtgagacccattgatcagttcagaggagccaagggatattctgatttgaggataaggtggagagagcagattaggctattgatagactgaagaacgagtgaaaaagtagcaggtgtaaaggagggaggcaggagtgagagatgcaataaatttttctaaagtagctgggtcaggaaaatttgaagagctagataaagattacagtagaattcccagggttctatatttttagagggattctgggtaccaggaaaattcaataagaaattctggggttaggacataatttttataaaagatttattaaatatattattcatataccatacaactcacccatttaaggcatatgatactgtgttttttagtgtattcagagttgtgcaaccatcactgcaaccaattttagaacatttttatcacttcaaaagggaactatacccattagcagtctactcccccgtcctcctaataaccctagctgtaagcagccactaatctgctgtctctatagatttgcctattccggatactccatacaaatggaatcatacagtacgtggccttttgtgtccagcttctttcattaagcataatattttccagtttcatccatgccatagtatgtatctgtacttcatgatttttatggctgaataatattttattctatggacatatacacatacattttattaattaatttatcagttcatggacatttgggttgtcactttttggccattatgaataatgctgctatcaacattcatgtacaagttttggtgtgaaaataagtttttttcttttttggataaatacctgcctgtgagtggaattgctggtgcttatactaactctatgttcaacattttcaggaactaccagactattttttagagtagctgtaccagtttacatttctaccaacagtttatgagggttctgatttctccatatcttagccaactcttgttattatctatcattctgatagtagccatgataatgggtatacctcattatggctttggttgcatttcctagttggctaataatgttgagcatcttttcctgtacttactgactatatatcttctttggataaatgtttcttcaaatcgtttgaccatttttaattgggctatttatctttttcttattgagctttaaaaattctttatatattctacatgcacatccttaattatatgtatgatgtgcaaatattttctctcaccttgtgggctatcttttcactttcttgccagtgtgctttgaacacaaatgtttttaattttgataaatccaatttatctgtttttttcttttgtcacttatgcttttagtgtcgtatttaaaaaggcttgcctaatccaaagtaaggagtatttactcctacattttcttttgagagtagtagaattttagctcttatgcttaggtctattatctattttgagtttaattttgtgaatggtgtgaggaaggtgtctaacttcactttttttgcatgtgaatatacagttatcaccgaaccagatgttgaaaaaattaccccctccccgaccctcaccattggattgtcttagcactctcataaaaaattgatcatagatatatattcttattttgggactcttaagtttattccattgatcttcatgtatttccttcttccactgcgtgcagttttgattaccataactttgtggcaaattttgaaatcagaaagtgtgaatcctccaacttttttatcctttcataggattgcttctggctatgctgggtcccttgaatttccgtgtgaattttaggattaactcatcaatgggaaattgggatgcgggcttctccaaactctccaggcaaaactaatgttccatcaggattgtaaaccacaggtaaagatctgagaggaggcaaataacatttactgattacctaccatgcatctaaattctgcagtggtgaatttatatgtcttattgtttaatccccatggtagccttatggagcaaatactccaattttcaggtaataaatatgagtctaagaaaggttgtcttgccatagtttataaatagtgatgtcaagatttatcttaggtttccacattagttattctacctctctccccaaagaaaagtagagtagataggctggaaactaacccttccactcctatgaatagcctttgcatcccattagggatgcaatgtaacatttatgttgtattagactttatacatatatttcttccatttgtagaatgggaatgtgtggagtcattccagccaaaagcagaagaacaaaagaaaatgaatcatacattttcaatatggctacatcataaagttatataagaggaagaatacaaaagatgaaacatgttagtaagagggagctatggtggttcccaaatgacaaactatgataaatatttccccaaaaacaaaactacaatgagacaccccctcacaaaagtcagaatggctattactacaaaaacaaaaagtagccaacattggagaagttgtggagaaaagggaacacttatacactgttagaaggaatgtaaattagttcagccactgtggaaagcagtttggagatttctgaaagaatttttaaaacagaactacctttcaactcagcaatcctattactgggtatatacccaaaggaaaataaattgttctaccaaatgacacctgcactcatacgttcatcacagcactattcacaatagcaaagacagggaattaacctagatgcctatcaacagtgggctggataaagaaaatgtacatatacaccatggaatactaagcagccataaaaaataatgaaatattgccctttgcagcaacatggatgcagctggagcccataatcctaatcaatttaactcaggaacagaaaatcaaatgccacatgttctcacttataagtgggagctaaacattgagtacacatggacatgtagaagagatcaatagacactgggcactggggacccctagagtagggagaatgggaggggaggaagggctgaaaaactacctactgggtactatgctaactacctgaataacaggattatttgtacaccaaagtttagtgctgcaatttacccatgtaacaaacctgcacatgtacccgtaaacctaaaataaaagttgaaaataaagtaaaatggcataaaatgttatagatacatttatctatgccaatgttttgaatttgatattttactatagttacacaggtatagctcttggggaaaattgggtaaagagtatgtgggaccattctgtattatattttcaacttcctataaatacacaactatttaataataaatttttaaaaaagaaaaaagaggaggcaatgtgctgagttttcagtaaagctaaaattacttaaatacttctgaaattattttccttcctggtgtgtgactatatatgaaaaatatcttattaaataatagagaaaatgcatagataatatatctttttcctttttctctctttacttggagtaataaaaagtttgtaacccttggtaagtcttccaaaattgttaattttactttgctggttcaagaaggccaaatctagaaaccactaccatagatgacgggaagctactgaagaattttgaatattaagtggaatgaatctttagacttatgtgtaagacaaatcacccttccaacaaacgacgttaggacaactgcacatgcaaatgcaaaagaatgaagttgaacccatacctcacacaaccctccaaaattaacaaagtaaattatagacttaaatggaggatataaaactcctgcaggaaaacagaagagtaaatttccatgatcatggagtaggcaattactttttacatttgaaatcagaagcataagcaacaacaataaagaacaatagatacgttaaactttgtcaaaattaaaaacctttgtccttcaaagggtaccatcaagaaaatgaaaaatcaggacttggggtggagcaaggtggagtaggagtctccactgatcatccctcacacaaggagattaatttaacaactatgtacacagaataaaacaccttcataagaaccaaaactcaggtgagcattcacagtacacagtacgtggttttaacttcatatcaatgcaagaggcactgaagaggcaggaaaaacagccttgaattgctgatgccgcctctctcccatgccccagaggtgacagcatggtggagaatgctactgtgtgctggcaagagggaaatcacagcaactgtgacacatttaataatgtctcagggcatttaataatcaaactcccaaaggtcaaggatagcataaagatcatcctaaaagcagcaagggaaaagaagcaaatgacatacaatggagctccaataaagcatagagaacccagaaacaaatccatgcacctaaagtgaactcatttttgacagaggagaaccaagatcatgcactggggaaaagaccatctcttcaataaatgatgctgggaaaactagatatccatatgcagaagaataaaactagaccccctatctctcaccatatacaaaaatcaaatcaaaatggatttaagacttaagtctgagacctcaaactataaaaccactacaggaaacattggagaaactcttcaggacgttgatttgggcgaaattttattgagataccccaaaagtagaggccaccaaagcaaaaatggacaaatgggatcacctcaagttaaaaagctctgcacagcaaaagaaataattaatgaagtgaagcgacaacccacagaatgggagaaaatacttgcaaactacccatctgacaagagattaacaaccagaatatataaggagctgaaacaactccataggaaaaaatctaataatccaattaaaaaatgagcaaaatatttgaatagatatttctcaaaggaagacatacaaatggcaaacaggcatatgaagtagtgctcaacatcgctgatcatcagaaaagtgaaaatcaaaactacaatgagatatcatctcaccccacttaaaatggcttgtatccaaaagacaggcaattgcaaacactggtgaagatgtggaggaaaggaaacccttgcacactgttggtgggaatgtaaattagtacaatcactgtggagaacagtttgaacgttccttgaaaaactaaatatagagttactgtatgatccagcaatcccaccgctgggtatataaccaaaagaaaggaaatcagtaaatcaaagagatatctgcattcccatgtttgttgcagcaagaacttggaagccaaaatttggaagccaaaacttggaagcaacctaagtgtccatcaatagatgaatggataaagaaaatctggtacttatacacaacagaatactgtttagccatttaaaaacatgagatcctgtcatttgcagcaacacggatggaactggaggtcattatgctaagtaaaataactcaagcacagaaagacaaatattgcctgttctctcactcatttgtgggatctagaaaccaaaggaatagaattcatggagatagagagtagaacgatggttaccagaggctaggaaggatagtgggagggttgtggggaagtggggatgtttaacgggtacagaataaatagaaagaatgaataagaaatggtgtttgatagcccaatagggtacaatagtcagtaatagtttagttgtgaatgttttaaaaagacaatgaaaaatctactcacagaatgggagaatatatttgcaaattatatatcagataaaggactcacatctagaatatataaataattattacaatgtaatttaaaaatttgtctaatgattttagtagccatctcccgaaagaagatatataaatggccaataaatacatgaaaagatgctcaacaccattagaaatctgaaaaatgcaaatcaaaccacaatgagataccacttcacaccggcttgatggctactgtcaaaatgatagataataaaaatgattggcaaagatggagaaactggaatcctcatacactgctgatagggaatcaaaatggcacagcagttttgaaacatagtctagcggttccttaaaatgttggacatagaggccacacatgattcagtaatttcactctgagaaaaataaaaacacatccacacaaaaacttttacatgcattttcaaagcagcattatttttacagtcaaagagtggaaggaacctacatgtctgtcaactgattaatggattgaaaaatgtatgaggtccatacaatctaatattattcagcaattaaaaatacagatacatggtacaacatgtatgaatcttggaaacattctaagtgaagcaagctagtcacaaaagaccaaatattatataattctatttatatgaaatgtccagaataggcacatctatggagatagtagtttagttgtttcctggggctgggacaagggagtaggagcaggaataagaaatgaccataaatggggacagtgtttctccttgggctgatgaaaatgttctaaaattagattgtggtgataaatgcacaatgcagtgaatataacaaaatgcactgaactcactttaaatgagtgaattatatggtatgtgagttttatcaaaataaaactcttaaaaaagtcgggggaggatcactaagtgtcacagtggaggacaggatgtaagaagctgagatgatagacaaggatataagcaaagaccatgtttacatagttcaggaaaattaaaagcagggcttgaactaccatagtggcaatgggaatgatatagtgggaacaaatgcaggatgatgtggtggtaactaggcacactttctctctacatcatcaacacccacttgatagccactttcacccacttgagcgctactgtctctgatgggtagaaacctcactttatttgaaaacacccagagccaaacgtctgtccaccatctcctgagttggcctgcctatgtggagaatcatttaaattatttttactatttgaggcaaaatgtgcttgtctgcaacatctacccattgtctttcattgtgccttgtaaaagtaaatatattactatgataatgtttgaaaacgtttgtttaatagatgatccagatctgctggagattatagactgtatcaatatttgtacaataaaggtcagagagacaattctcaagttagaatttttgaaaatctaaactgttcatcagataggtagatgaagagaccaagccctcatgtggtgtcagaccagctttctcatcccaaatattaatacattttggttgcacatagaaggaaggcataggaaccccattgctatgtggggcttttactgatggcatctttctggaatcctgagaaggtactatccacactcctgtcattcagtttaattgaaatgtgaccctttcaggcaacctaacaatatgtttacattacacagaatttttcacttaagattccccttaatatttaactaacaccactaaagaataatgcgactggcactatagctgtatcagaatgggaaatcaatcagttttcaatcttgtttggcaaccctctcactaacccaggcagacagagacccggggaaggggagaaagggatgttaggccttgagccagaggtgaaattaaatctgctttgtatctattgtgaaatctgcctcactttccaagtgctaacaaagggacaaactgggagaggcaggtgcctgatgtgtcttctatctggaaaatcgggaggtatcccaagaagtcacgctcattgcttctgacactttctttaaaatattgctcttttcacccatacaatttttgtcagtaatcctcaaaggaagataatacttggaatttcaaatcagcagcaccttgatggcaaagtcaggtatttagaacccaatttaactcttatgctcccaaacagtagaaataaaaacaacaataacaataataaagttattttacattaaattatcatggtacagttacaaagtacttcacatatattgtcttaatttacccagtggagaaaactgtgctgtttagctattcaatatatgttttgtttgattttattatgaaaatatatgaagcaaaaagtctttctccatagaaaaatcaagtaaagcccatagaatagttattagcctagcatatatgagagtgctcagtgtaggttctttctcccttctgcccctctaaagctactttggctaataggcagtaaatgttcctaataccttcagcagtagagattagttatcatttcccccattatgtacaagaaggatccattaagcatcccaagtccagggaagggaaagggatgccaagaagtagacaagaggtacgagagtaccacatccccctttctcccacaaagacaatcatgccaagacagtaggctgtgttcttctgacctactagtttgctcctagttagaccgtagacttaatcttgcagcattggttcttgtggaaaacaggatgatctgttggaataaactgagtacctgagatacaacacaaagcaggtgaagcttgtgtcagcgcctctcccttgcatggacccagtgggagataaagagattatagaagaaaagaaactgaattaccaggtcttcaataatttgttgtgatctattttttcattctatttacttttaaacctactttgtatttgtaattttattttttcttaaagattctcacttccttcagtaatataggccacacaagctagatccacccttgaagagaacttaattcaaaagaatcccacagcaaatgactgcaaccttcacagccaggccagattcaggattcaatgctaaattagtggtggattcactggtgatgccaaattggtgatatcaaaagacaacaaaccaggctcaaatatgcaagttgaatgcagcattttttttttttttttttttttttttttgagatggagtctagctctgttgcccaggctggagtgcagtggctctatctcggctcactgcaagctccgcctcccgggttcacgccattctcctgcctcagcctcccaagtagctgggactataggcgcccaccaccacgcctggctaattttttgtatttttagtagagacggggtttcaccgttagccaggatggtctcgatctcctgacctcaagatccgcctgcttcggcctcccaaagtgctgggattacaggcgtggcagcatttttattattctgaaactgatctaattttgatgaatttttaccttcctcctaggtggcagaaaaagttcaacttgttagttctgtttcttatttttgattccacttaaaatgctcccctgcaagaaaattcttgcccttttcagaattcttcccttccccatttccgtttccaaagatgattgctgagtacaagggtgggaggatgtctctcagtccggtgtccaacgggaggggcccctctgatctcatggagggtgcctgtgccttttgctgggctcccattgggtcagcattaagggggctgcctatgctgacaacaactgaggacacacccctttaaagctcaccaaacactgtcctcctgctattgacgtctagaatgcagaggaagctcctggataccttctacaccacacaggcgttaaagattttggagagctaacctcagggcatgttactttggtggagctaccactgtgatctcctcccagagcacagttgtccccctcccccaggaggcatcaggatgtgtcttctctctcccctaggaaaattccatgtcttcatttctccccacaggaaaattcctctggaaaatagcaggtccttccgttttctcttcctctcttgaacgggcttcctcgaagtcatctccttcttactgggtcactaagcctcccagctcggtagacatggaagaaaaggtgtccttcctgcattatagaaaaagcacagatatgccagatgtgtgcttcaggcctggttcttgatgtgttaattgaggctaacaggttttagatgattcgtttcatttctaacagaaccagttgttcaaaactattgtcttgtttccagtgccaaagctgtggatattcaatgatgtttatcactctccccctgccgctgcagtcctaccctgcactgctaatcctccctcagcaaacagatgcccctggaacaatgtaggggtgagcacaaagaaattcaggagaagaaagtacattcatgtaattcaaaattgttatctctatcataagattagtaaaaagcctttgttcagattttttattgtgagcagtgttgtattttttgttattgtttcaagggataggttgatattttgatatcacttagaaccgagtcggtaaactacatatttatctttgatcaactaagattctgtttttaaagaaaagaggacatctttggctagtaatgattaggtaacagtgaatggcaggtgccatatggatccttggagcacagacggacatcaaccagcaagtatttctcagattctaccctaaaatagtgacagtatgtcaggtgtggactaatatatgtaatagctttcaaaaggaactgaacaactagcaagtaaagagtaatttatattaaaagatcccaataatagatggactatggcaagaacctctgaactagtctctctgcttcttctctacctctttacagtgtattatctacactgcaatcaaaatcttccttccaaatgtaagtaactgttcaatggcttcccatgggactcggaataaaagctcacactctttacaatggccctgcaggttcctcatctcctacctccagcatcttcactgtccctctgctccaaccacactgcctctttcttattcctccagacctcccaacacagccctgcccccaagacccttccaatgactctgatcctcttccctgcgctacccagtgtctcactccatcgattcctccacatcctgccaaatgtcacctaaccagaaaggctttgttgaaccaccccagataaaataaagtcccctgcctttacccatcactctctcttgcccggtttaattctttctagcacttacattgtgataatttcttttctgcctcctgcctcttttcattggaaaatatattacatgagaggaggtttgctttattcattgctgaatgttcagcacctagaataatacctggcacaaaataggtcctcaattattatacccaattcctcccagttctcttggaagtttctccattttaccattgaaaattccacatccttgtgattcactttgtcccagtgaattccaaacagttggccatcctacccttaatagatagttgttgaatgaaggaaaggaatgaagaaaaaagaatgaggacagggaaggagggaggaatctaggacagaaaagaagggagagaggaaaaaaaggatgttaatattttcttgttctatatgtagaaagcaaaagagtatttttgtaatcttttttcagcaaatgcctggatcaaattcaatatgattttaaagccatgagaccctctcattcttggttttgatgttgcacggtatcataatacatctgattggaatttcaatatcaggtttaatatactatgcaagctggtataggctctgaaattatgcatattcatgagagcaatcacacccttacttttgatataactggcaaagtaaggtaccacaagagaacaataatcaaagaaaaagggaggactaccagttgttatttacttatgacattttactggaaaaacttaagcaacatgaaagactatttctaaatgaagtactaaaactaacaagacaatgttataaagtgtcatattttctttccttttatacaataaaacattgaaaagctccaccactatgcagccacttcaccagatgcaataatatccaaatgtgaaagtaattaataatattgtagttttaattcccttggtatttcagagatatcctttgaacagcctaaatcaaatcatactggtacttatgagaaatagatatctcttgtgagtccttatattgtgcttcccaagaacctacagtgcatttcagttatttaccttgaaaattcttcagcccatccagagtgggtttggaaatttgtaatcattttgtagaatgtgataagggaggacctgtcttcctaaattctcaagcttggaattttcaagtcagtgtcaggaccataggctctctaatgcatatatatttgccctgagcaaataattatttatctctgtgcttcggtagttgcatctgtatgttaaaaataagattattgctatgttgatttcttatgacatgagagaagaggctttaaaaattaaagaaaagaagaaaacactttaaacttaagatgggaatcatatcttattctttcatattcccagcgcctagcagaatgcctggttaactcaccgggggcattagccagttccttgtctactacatcattccatcttgtatcattccacgctttgaagcaggtactattacaccctatttgtaaggcttagagaggtctagtggcttgcccaagaacagaccacaagtacacagcagaggcatgattagaaccctgcccttctaactgcagtctggtgctctttcctggacacctgcacatctcttccagtaattgaactgacctgcatgttaagcatttcacattgctctaacacaccaaagcctatctacagaaatgttcagaaagatttgttcccaagccctcttccatgtcatgtatgcactttgttcctggcactctttgcagaccatctctctcccagcatgaaagttgtctataaaccctgtgtagtcgaattgcaatttggaatctctacaggagcccgactacattaaaccaatgcatggattaacacctacttcaacacacacaaccattctccacgtacatgggcagtttttacccaaccaaacaataacagacaggttctactcatacagaggaggcattgaaaggcacagtagaaacacagacacgcagtatagtgcttcgtgtccaggtgcattaatgagctgtggcctcaaatcccaggttcgccaagagtgtttctgctcatgtatcaaagcaaagtcatcctgggtgtgagtggaaatgctagttgcattcatgtcagcactagacatttcctggaacccattaaacaagattcattttccaaatggattttgttaatttatttttttttccttttgtagttagaaacctaggggaaaattgagaagaataaatgtggttaaactgccccaggggatggcttgtctgtagaagcatcccaggcataccgaatggcgtacaaaacagaccttaatgagtactgcttgtcaaaggatctgatatgcattttgcagaataaacataactcctttttcagcagttgatccactattctctagggaaatgaatgaagggccatatactgctgtctttgctgcccaaacatacacttgtttgaagggaaagcaacaaaaacaaaacaaaacaaaaaaccctgctggtttctctattttctaattacgttttctttccaagacatattttgttgtattggtacaaaatacgttcagtaaattcaaggaggagaaaacattccagtctgaaatggatttcagcttggcaaaaatgaattaatagaggcatggcaggtcacttatttaactaagtacaggggctgccctattaaccttgagtgagctgagagaactaaagaaaattctttgtttgtcctactgcaaaattggccaaggcaaatcaaaacaagatgcctgggcaaatcaaagtgacacgttcaaaataaaatcatgttaatactggttgcaaatgaaactttattagcaagtcaactttagtagaagtgctgtctgaatgtaaaaatctgactgcttgaaaataacacgcccccagtaattaactctcctaataggactacaattaagatctcgtaggacagcatttcgggaatttcttcctgcttattctcaccatatatatttcttatggctgcaggttagtttatacctccaaatatcatatttctcactagaaatagcactgagtaattgggtgctgcagggcttactgttcaatactgagtcattttgattagacccatattttatcacttgtgccattagcatcagacatttttttaagccatgaaactcctatgttcttggatttgatgttcataaaattaaggaaatcagtttctaccatctatttttctcttcaaaaatcaaattacgtgacatctcatccatgtcaaggcagtctaaatcactgatcattttccatctgaggctaggtgtgaagctaatccattttctgtaatgaagcagcgaagctaaagaagggctgagctatactctgaactatggaaataatggatctaatttagatagttaatccagccatttctgaatagtgtgcactcatgtttgttgagctaataatgtccatcttaaatcaagaagacatttaaacctttatggaatatctttataaaatatcaacctttatggaatgttattaaaaatgtatgtatggtaatggacaattcttcaccagtgctttggatattctgccctcagaccaaagatgcttatttttcttccttccctctcttcttccttttctctccctctcctctttcctttctttctcttagatcttcagtaatttctctgtactccatgcagcatgtgcagttgcttaattcaatccatcttttctttttaaaaatttttccaatctcataccttcctctatttactatgataaaactcttctatacttcataggaaactacttaaaagaagtatgtaccttcaatgtctttctccctaaattttcacttacttctaactcaaacagttgattctttatactaacacatgaataaacttgccaatgacatcttatgttgctaaggcttatgcgtgcttttattgtgtttgtttttactcatttttctagagcatttgacatatctccttgtcaaagtgttctcttctcttgccgtgggggacaccactctggttgttctttcttcatttcctttcttggatctcctttttcacccagaaatatcgttctctccaaggacttttttcttggtactctcctttaatcgctcaatgatttcatacaggcccatgtccttaggtgccacttctttgttcatattcccagcctgctgagactcaaataccagtgctcttctagatgtctctacttcagtacccttttagacaactaaaacctcaaactgtccaaaattagcccctcctttcctctctcgaaattgctctttgacttattttcctaatgttgctaatggatgaggcttctatccaggcctaaaactagaatctcagttatccaagtgtcttttgcatttaattttacaccagatattatctattctatctcctatctgtgtacgtcttcccattcataatgccttttaattgtcatttcttcagtgaattacaaagatatcttctgaaatattatcccttcttctggtatggcttcctgcaatattcaattccaatgtcatgctcttgattaaaatctttcagtggtcgctcactgtttctagaccttagctggaactcttggaccaaaaaatgtgagctacctctgtatccacctactttttttaaaaaggcaacttccgcacttataagggacagtaatccttgtgccagttgaaatattttcacagccatgattttatcacagactgtaggaaacagattctcttgcttctagaaagcatgttttgttagggaactgtgttgaattcttcacctcaattaacctttattttaaaccttctgagcatcagaagtatttactatcttatattataaatgcaaatactttttcctggatcaaataattgaagaataactaggattatgaatgggaaagaaaggtttcctatgcctgagtgagttgagttgctgttctttgcttatcatatataaagagtgagtgaatttattatcatcctggtatgtacatgttaactcaaaattattgtggtactcactgtactttgtactattgggttccaatggtttgtaagctagtgatttatgcacataaatccttaattcttaactaagaaaatttagaaattttaaaatttaataccctattaagaaaaaagggtgaattttcctgtgctctcttatagcaatcatcttatcaaaaattattgcccttttgagaaaagtacatcatgataacatcactttgtatcttctagctttctctgatgttaggcattttttcttaaacaagttaaatattcctcatggaaaaataattagccaattccttaaatttgacaaaaacatcattcagaattgttgctatcattccttttttttcctctttttttggatattttatgtccaggcaaatgggggaatgattggctttatattctttacatgaactgtcttttttcctgcctatcctagtaatatcacagcatctaatttattttcttaaccacataacatatcctttcctcttttctaataagagaatatagttaacttaggcaaatgaagcagtgcctgtgacatattaagtgctattaaatgctcaataaatgtttcatgactgaataaactcaaggccaggtaaacataagaatagagaaaaaataagagtgaagctgtgattggtagttttttgtttgtttcatatctataacctcttggtagcttccccaagaatagttaattgtccatgtgaccaggactttatatccttatgtcacctacttctgcttccttcccccaccagtttctgggaagaattttgccagatcaccagatgcacacagttagctactaaagaatctcttgtctgtctctttagcttctccataaatacacacatttcttcatttgtttttaaggcaatgctgtatgtgtaatcatgtgtgaatctttattgaacacttatggaataagccacctgttcttacaaattagctgagttctcaagaaggcccaaattagtgaattagttgatgaaggaaatttgttgcggagacagcaggcagctaagaaatttttcagcttgtcaaaggtattgttagtctcacagcttggcaaggagagaagaagataccattttgaagaattttaggtagtgtcttaataccttacactcactaaggacgaaaatgaaattgcttgtcttatcagttaaagggaagctttgctgatgtcagaccatagcccagaaagttaactaaaagttttgtagaagtagataatcttttcctggtgatcgatgtggtgagattggaagtgagttgccaggggagtcatggggaaataggcttaatcattttatttgtatttgtgctgaaggcagtgctgaacaaacctctgaagtcacttagccatgtcttttccagggggcatgcaaggcgactgctgatttctacagacactttttaagcgattaccagtgctggcaagtggaactacctttccggtcctcttacaagcatccagtcacttgctgaaatgtcataagcgatataaacctgctgacaggccaggatcattgcatctcctgcctcctccttccacgtaacaaatctcattgttgattggcatatggcagcaagcatcccaacacccagagtggtgttcttatttctgagggagcagggtctgtgtgtgaattgcacacacagggagcaatcccctgccctgatacaggcaacctgagtgcttagttccttctctgctcagaacttagtgtgactatgtggcctacctcacattgtttgtgttacacctacacaggaaaaaggaaaaatgtccttttgattccatgcttgtagagatgttcatccaatttgaatgaacatgtagccaaggtagtgtcttccccctttcttctccttttttttttgtctcataggtgtaataacatttcattttaaaaataaatatgaaaaatggaaaagcataaataaaaaataaacacatttgtgagttttttatgcagatataaatactgttaatattttaatttttatcctctggccttgtacttctaggaagtaatgaatggtctggttctttgggtccttggagccagtgtgggtaggagtggggttggcagggacagtagagaaggatgcaaggaaaatatttgctctggatagataattttgtctttttcatccaatcttatggggaagaaaatgttcaaaattcaataaatattcattgaacacctactatgtgctaaggactatttagatagtagaaacactgcaataaataatgcaaaatgcctttgtgaaagttataatctatggaaaatggaagagagagagtagaaatacccagtatgaaacttgacaattcaatacaaagtagccaaattatttaaataaacactttaagcacctggtatatggcacagttttgagtgatgatgtgttaaattcaaaatcaggaatttttatctaaactgtgtatctacaataatggattatataaaatgagacagtcttataagccttgtttctagatattttatagccttttgacaattatttaagtctgcatgtagaatttatcaccacttaagtagaatctattaggaccgtagaatctcagagatgaatttaaatggtctaccttctctatttctattatctatactacactcctgctcccatggctgaatcctctccctgatacattaagcagtaattatcagcctctttttgaaatcttcaggcacaaaaagctctctacttcctgaagcagcccattccaccaaccagtagctccaattttcaaaatgatcttccttatattaatctgaaattcaagggcccatagtttcttccgctgaaagtatgtgcaagtctctgggaactatctcaggcagttgaagcctggggatatttcttttccaagtttcaaagttcaaattgccagaaagagccctgaaagggtctaaggtgttaaaggtgtccgtaaaactgatgaagaaaataatagcttgtatcaaagagcaccagtagcatgtggaagaatgggttgttaggggatatggctttgatctgccactcgcttgtcagcagagttgattcactcacttggctagttgagaaggtggcccttcctccatgtgtggtcttcctcaagccccatgctaaggcaaagaagttgacctaagctctgtcttccataggtcaaaggtacctgaatagttgagttattttagtagaaactctgaatatggaattgcagtttgaagcagccaaaatattcatttttatagctgagaagagactctaacatgcagaacatgttgtcttggagaagccagtgatgaaatgtgttggtttgagccatagcaacagttcacctttatatgcagaggaaatggaaatccattttaatcatcaatgaaaagataatcattctaaagttcctttccaacatctatcacaaacatactaagtttccttctaaaaataaaacaactgagttttccctccatcttgtgattttcaatggaacctgaaagctggtgtcctatcctcttatgcccttggtggccagtcaaaagagaacaggttttattcattaattacatcattgatttattcaccaaacatgcattgagcactcacgctgtatcagacacaatcgttagtactaaatgtaagaaatcctgagatcctcaaataaaatagcagaatatgggtggatttgagtagactggtttagaagatattgaggaaggtgatttgatggtaactaaatatgagagtagtgagcgcattaagattaactctcaagtttcttatatgaggagttggggagatggtggtaagtccacaaacttgggtaaggcacccaattttacaggagcaacatactgaaggaaatccgtagggaaaaggtgaaatggtgtatttaccaatgatggtatttgggcatcagggtctggaagctcttcttcagatatggaagcccaggcttggtagtgtagtggactttatggtagagaagtagcatcttttctataaagaaccagattttctttttttttaaataagagctcctggttaaaagctgtgtgtcagatcccatatgggggctctaagatctaattttacttaagggccccaaggcacagaggctagccaagattctgagaagataccaaataaaaatcttggaaccaatagaaagcaattttcataattaggaggaacacggcaccccatatatcatcattagtctgagacaaggaacagaaggttggggagggaaaggatggtttctctaaacagggaacaggtggccagtgcagtcagggccagctagggaaaccttaggcaactctgctcgaaaatttctctgttcctcccctagaaactctcagatacagaagaaaacaggatgattagttattggcaattagttattagttattggcaatgggtgtttgcctccatgatagtgtttttgttcttaacagagacacagagaaaggccaaagggtagaatttaatggcacccgtagacactgtggaaaatgaagtgtttttgtatgtcctgataaactgaagttttgatgttacaaaatgtccaaaatgcaatttggctttcatttgaattgcttcctgcaaagttaattgtttgctcccaatccataattgatgatagcttttcccctattgcagttagaccaaggaatcttggcagtctagtgctatagaagccagacacatgcaggtaataacaccccaagaagagctgaaatattagccttcggagacacaggctgtgcaaatttctctggcttacaaaagagacatcagttacaccttagagcctgtcttgtagacttagtttcataaaagttgtataataattttggaaagtacagatgacatgtcagaaaaaatgccagaggaaaagctctggggagcctgattaatcagtttcacagtaggtataaggaatgagggggttctgatagctaaagtagtgatttgcatgtctaactaattttcttctgccatttcttctccattcccatgatatccagtacagagtgaccatgcagtgttgattgatcgaacagcaaccaccacatacatgtcctgccccaccacaaaaggaaggaaggaataaaagaaagaaagaaagaaacaaacaaacaaacaaacaaaactaagcaagacaaaacaaatacccatgtcagtggttcaaagattaagattgtggctttgtgtaaagttctttccctttgtagacttgctgcataattattcaggtatgatggttacagtttttaaaaaggaagggaaattgtggtatgtggtatgtaaatatttttaaatgttgtctctctgttttgatcagtttttgttttattcaatttgtctttattaaatcttatcaaagcaaaacttgttcttcccatttctctgttttgattacaggactactgaatggagagctttctgatttctccaagggaattgttttgtagaaaaggccatgctagatttcccttgccactgcctctttctgcttggaaggtaacctttaccaagagctatagcctcttaatcttttagtggaaatcgctcttgtgaaaacgagccctgatagtatcttggctcactaattcatgccatgccgctcaaaattaaagcattaaaatttcatagatataataccatttataaatcatgtcataaaaacattcattttcttatagaccttgaaaactgggcatgtattcctcctccagctgttgcttaaagttcattacagcacaccagtatttgtcaaaaacaaagctctggtaaagtggggagatatttaggagcaacaccctcagagcatcaaggcactgtcctcccagcattgtgcacatgttcctcccattagtggtcatggaaactgcaagcccacctctgtgtaatcagagattcccggcagaattgtattaatggagcaagtggttctgggagggtagctttatcattctttatgtccttattctgttcacttggagaaagagactatttaccattttccctaaatttatctcctataaaatttcaatatgtttagtggatgaaggcaacagactaattaagtagacggtaaacatttgccacatttcaaaaaatgacaatgacagacgattctttttgccatttacccttaggcagcagatggggacttgataattgtttaagcagcagaaataacttgccctaatttactatctagttttttgtttgtttgtctttgattatgcctgaataaaaaccttttgtccatttgaagtggtggaaattagaatatccattttgaggtgtttctgggatgtacatgccacatatttggcttgcagatgctaatgggtatctaatcacatttgccaaccataaaatccctattggtaaaacacttacatctgcaataatctgccactttcttgaaacatgctaattttcttaaataatgtagaggcctataaggacttctattttatgtaaacaactagatgtagtaaacaatcagttgcaagaggtcattatatcataatctggactttgttacttttcagaagtttggggtttttgtttgttggcttgtgttgtcttgttttaatttcatcgggctagcatttcatagtagagtattaagatggattctttgacctttgatatgaaaagtagctgaaccatctttttattgcttgatttgttggattggagaatattttatctattcagtattaaagattagccctaggaaactgggagctgctctaaaatatggaatttctaagtcgagtgcattttctccaggctaaaataaacctagacacagatatttgatagtgtagaattcccttaatcttttaggcacagcatctgtatgctcattcacatggactcgttttacatacactacctacccatgccaccaggatcatttatctggtatgtaaaatctgatacgtgtttttgtgctaattgaaatattggtttgtttgttgtcagcctcagatgccttctccaacaaggctaaaaacaatttcaagcagaatataaataagacgcatctgaggatatacctatgcatacacaaatttgtgtgtgggtggacatacatatattctacacaaatgcactgagggagagagcaagagtgagtttctattttcattctgtcgtgcttacgtatattcatatgatttcacattgggtatagctttggatctgagaaaaccagactattatatgtctggtaacttcactggaaaatctgaaagaatctaaattagccagtcctgctgatcttttggatacatgaattcatatgtccactaatttgttttctttttgctttttattgtggagaggggagaaatccaaacatacacaaatataaacagaataatataaaagaaacctctatgcatcgatcaccagctccagaaaataccaactcattggtctctgcagccccatcttcatcatcagtcacatcttcccaacccttctcccacctgttttttttgaggcaaatccaatagcatattatttcatttcaaaatattttattatgtactttcctaagataaaaacatagtttttatatatgagtagaataccaatcccacactaaaaaaattcaccgtaagtcttaatgtcatcagatctccagtcaatgcaattatctaatgcatcatacattttttaagaaatcataattcaaataaaatacatacattgcttgtccatagattgatttatcttgagactttttaaaacatatgggtactcctctccttttctttttttcttcttgcagttcatttgtcaaactgcaagggaaaaaaatgattgtttgtcctgtagcttctcacagtctagtttttgctgattgcatccccacgatatagcttaatatgttctttggtctcttatttactgtacttagtagttagatctagaagttttattatattagatttttgtggggttttcttttgataagacatttacatatgtggtcttttctacttaataaaaagcacactatatgctttatctctttttgaagtgctagccattaatgttcaatgcctaaatccattagttgattagagattacaaaatactggtattcttatcttctcataccttcatcatttattagatgtgatatttttataataaaaatttcctcctttttattctttggtgaccagtagtacaactagtgtagccaagggaggttaaactcttgattcttttatttacagttttcaaaattatcattagttccctacagtatccctcggtactcaataattttttactatcatgaagaacacatggatttaaaatttgttgaagtatttcaatctattgcatttacatcatccctgttgatgctcaaattgtcccatctttggcctgtaagaggctctaacaggttgttctacattcttttgacagattcatgtccactcttcactctgtaggggatatggaatcccagggattttggaaattgctgctaccctctccctttcactaggcctacgctttctgtttcttgctctttccggatgttctgtcacatgactttaacttggagatagctcctgaaggagccagtgtttatatgtaaattattgagaaacacaaaagtgccagaacacattagttttcaacaacctgttttattcttctcacatttttatgttatcttagggaaccagcttcacctggtgtttggaattctaactttttggtagccccttagccccaggtagcaaattgctgtactctttttgtgtcttcatcactgtgtggcttgtggtagtcacttgaatacttgttgaatgtatcagtgactgaaagaacaaataaacaaataagctcatgatctctctttaatttaaggcataaatctattttagatatggtgccatgaaacagaacaatcttagctgataagagagagttgatattgcatgtgcagggtgagagtacatttctgagtcatttgggagaggggcttcaataggaaactgtcccttgaatggaaaagcattccctgtacagtctttcagacactaattttgacaagcaccaaagcaagacacatgctttggagtgttatgggattttatgccaagaggttgaaataatttaatggatctggagagggtggaggtagcatagaattatggttgctttatccatttttttctgatctgtttaggtgatttatctattctgatttccctgaattgtttagtgctgagatttcatggaaataggtgttctaaaaaccactaaatattgttttttaattacctcacggcctcaaaggaacaagtaatcctcatcttctttttattggcactaaaattctctataaccaccagatcccataaagatcattctttttaaagccttgttttttactaaggaatgttgattttctagatacatcactgcaggatggagtcaggcaaagaataattattgtcattcaagtcagtgtttcataatctatctgggtgctaagagccaccccaattgggaagagtgcatgtgttataataaaattatctattcaccagacaaggaaagcaataactttgtagcatgtcatatgtctgtgttcacatatatacacagctggggagcaatggtaaacagtttcctaaacactcactaaattcatgcttatcaagtgtcttattccttaaaccaatagtctacacagacatttttactgtactcactccaaagtaaataatttttgagcatttaacctcagcaaattaggttgaaccatatgaaattgacaatttgtgggtcaaaaatacttgaacattggcaatttcatatttttcaaccttctaattttattagttacaaatatgtacatatgttaccatcatcattaattaatataacaagcacaataactctttgggtaaggatcaataatatattgggtgtaaatctgcatttccagtagtctcttgggtaatttctaaatcattgagttagttctgatgagatcagaccatcacagtttttactctgatactgtggctagctagaaacttgccctaggagatatgtcagctctgacagtttcttcttgtgtctaatgtgcttgccttgttactatttttagtcaatctatgttttctttgcagaaatctttttacgccgcttgtccattttgagagggctaattgataagttgaaactaaataatataatacatatataaaccagtttgactagaccattttattcagaatatgttgcacagtactcaaagagaagatttcacatgttgactctgacgtgcagatgaatgatggtgccgtagacaattaggatattagattttagtagaacttaatttatttctaatttttccagtgacacaatggatataaatgaaagttcaaacctagtttgagttgtgcctcccacaggcagtctttccatgtggcttggatttataacaacttggtggctgggttctgagacagagcatctgaaaagcaagcattccaagaaatcaggtggacatcggatagactttcatgacccagccttggaaatcacatagtgtcacttcctcatccttaattaattaaagcaattacaatcccatgtagatttaagaggagggtacatagatatctctatagaaggaatgtcaaagagtttgtggccactgtttataaaccaccacaccactcaatgcataaatcccttaacaaatggtcatccacatttactacctctactgacaaggagttcattatcacagaatgtaaactattccttttttgggacagtattaagtattaaaaatattttctcaagcggaacaaaaatatgctttcttattacccagtttttgttctcccttctgccctccggaacacagcaagtcagctttcctttttgcttggaagtagttttcaagtgaattgtgttttcttttggatgttcacactcctagttgctttgactctttcctatttctctcatcatgtggttatcttctaagcagacaatactttatttctatttctcttaaagtactactaaatttgaacccatgtaccatttaatactgcccctgcagactgggttgttaaaatactatttgcgtatgtaatagtttctcaaaagaattatctatagaacaatttattagtgcaaactgttaatatataatttttcagatactcagagtgccagcatactctgagccaatgagagctgatttgggagactataccggatgctgtcaggcagcaaatgtttgtgccccatatggcaaatgttctcagccagtgaatactctattgtaccatactcagttgaaagtcttcagcaatgtttgttatgtacccctcaggagcctttctttctgccctatatttttgtgttctagtgaactgtttgaaaccataatggccgacaaaatgtatgcaagtgatagtgctgagactgaggcaatgaaacccaggaagaatattccactggctattgacatgcagggcttccagcagtttgagaagcctttgatgaaaaggtcaaagtaacagatggtaaagatcagcaggaaattagggattggtataagtccttttgacattctgaagggcattataaaacatccctgtaggattgcccaacagttgtttgaaaaattcctagaagaagaaactaaggttgaattatgtcatgacttctagtgatttaacaaaaatgaaagagtgcctgccactgtataatgatttaacaaaaatgaaagagtgcctgccgctgtataatgccaggaactcatctttacaggaactatgtgcttaggacgctgtgtgatgcagatatactagctactctttctttttcagaaatgagtgtcccacaccacaatcatatttccatattctaggtaaattttgatcagagaagactgaagtagaattaattttcctacaatatgacatttttcatcaactacttaaggtgactttagctttttaaacagctacataacaatgttgacccatcttaagcttcttcaacaaagatctccatatttttttcaggtaaaagtctacaaagcccaattctgttcctcaccaccactctaatatgtaatctgatcatggtggtaatgaggaccatgactaatgtttattgggcacttgcttagctccaggcacaattaagtgcttttcactatttcaggaaatcctcaccacaaacctatgaggtagttgcttttattatccctatcttttgcatggggagtattatagaagctggataacttgcccaaggtcttatagttagtaaatggtggagctgggatcagtggagcagttgggatgatgtcagatgttgaacatgtcatttataatgtcaaatatctatcccaggttggattgtatttgtaaactacatgacagcaggatttgatctgaaacagtgcttgcttggttcagaataaacgctgaatgaatgaatatgttgtaagcctgttgatccatgaattcactaataagcatctgtgatgcaaagcccaattcctcctgctgcaaatcatgtctgtcaatcttaatgtgtacagaaaatgttttttaaagccatgatttcataattgtagggttccaggaaaacatcctcttgggagagtcagcagcattaaggcatagcaatatttttgttcaggatgcattaggtatctctgattttccaatatcttaaatgctagcagcagcttcagatatgaaattacttagtaagcaattctaataggagaaacaagatctaaaagagaaacatataaggaatcctacttctggctctcaatggaaactggcatgagtcatgctagctctaaagaaatatggtatccaccactgaaatcatgcaacaaaagaaacttagctgaaatggttgaattgagctttctcaaaggccaattgacctattttgtccgatggtatgtggaaagaaatgatatacgctacttcccagcagaaaatttcagaggccttatgtaatatattgccacatggggctttttctctgtcacgaggccagcaatatcccaaatatgagtgttagcctgggtcccagagtgaagaagacatctacccagcccattatgataaagcagtactagcaagaaataagctaagtccttgaggacttgggattgttaccacagcatgtgtaacctaagctgactaaaaaattataaatattcttggccgggcgcagtggctcacgcctgtattcccagcaattttggaggccgaggcaggcggatcacctgaggtcaggagttcgagaccatcctggccaacatggtgaaaccccatctctactaagaaaacaaaaaatcagccgggcatggtggcacgcacctgtcatcccagctacttggggggctgagacaggagaatctcttgaacttgggcagtggaggttgcagtgagctaagatcatgccactgcactccagtctgggtgacagagtgagactccttctcaaaaaagaaaaaaaaaaaaaactataaatattcttaaggaaatcagggctgagggtggagaaacatgttaggcataagaggaagaacaacaccttgcagtcccaggcgcttccagagaggcgagagcctaagcgcagacaccacctccaaggcatagttggacacactgggtggaagggcaaacacagagtagatgcacagttcatgctggaaccagatccacagttgagggcccaggaataatatgaaagaaaacagtatcttcatgtggcagaaagtgaataacatttattttagcattcatttcatctaatcttattgctcttccctatcataaccaacccattccataagcccttccttagaaatacatagctctctaccatctgtcagtaccttaaaatcaatcaaatacccagtggatttttattttacttatttattgcttaaaagaatagctttagattatgcatctcaaagtctgtggcattgagaagtcactggcctggaataccctgccacctgcaaaaatcaactaacctatctcacttcaatccatttcaaatatttagtttctaattagatttcatttgtgaaaagggttctacaaccaaaaatgcttaaaattactgcttctgacgaggccacgggctcatttcaactactttgaaatgattatcatcaaattctgtggactctgttttggtctgtcctaatctcaacccttcttttcagagcatgtggcagaagcagcttcactacagagataaatattcatgtgcattgcattttgctcacaggcactgtataaactatatttagaagtctgaatgttgagatgtactgtgtcaacattgaaatttaattactgtgatggactttaaatccatggaccttcttgcactgcggagtgaatattacctcttgtgtttcttcattctcctttacattcctatagaagagggttgcaatctgcttaactagaacacccacctgcccttctcctccaagtgaatgaaatgaactctcagttttacgactgttttatctttgtgttgtgaaaaagaaatattgtcttgctaaactctttggacacttcccaatatgcactatctctctcctactcctattatcactcattctggtaataaatgataatgttcattgctaggatttgtaaagcactgtcaagttagcccattattttaaactcaggttaaagtaaggattttagatttatgtaagcctggtgcagtttcattaagaaccaaaggcattttaatttttctccctctacccaagggactttacacttcttaatgtgacattaatcagtgttttaatatttcttcaaaatgtatctattctctgcatgctatttaccgtctttgtcaaagtcagtgaacaggaataaaaagtaactacatgatatagaaactatggtcttcttggcccttgtgtaatagccaagtggatgctgttaaaagtgaatctatccatggtgcctttcctatttctgtacaggattttgatttcattttaaatgaatgtcataaaccccaggtctgaaaactaatagaatttttgcatttacctactgatccataacctttaagttagactgtgtgtccatttgcagtcagttcgttggatgatgcaatgctttaacactgaatgaaaagatttctgctatattccagacaccagatatgaaggccagtttgggtggattattcttagaatgactttatattagtcctgatgggtagtacagaataagctgtaggagctagctacagtcccttaaatgagaggagacaaggaaagagacgtgtttgataacatgacaccgactcactttgggaggtggaaggctaattaggagtccagggattggcagaacatattgtctgagtcctggtcagtacacagtgagtgtgtacactgttgctgactggctggtccccatggagacattactgctcgatcagttctcctcagcgcctgtgtgtccagagctgtgactgtggctttgagatgcctggctgacgggcaaagttctctagatgctgagagtccggcgaacatgtggaggaggctgcattctgctgcccgtcctggccctgggcagtgtgatgcagcatatgcttgcacacaacgaatcaggtccaaatcccacttctaggcttactggttgagtgaccttgggaaaattatttaatctctaaattggtctcttcatctgtaacctgatgttggtgtgaggattaaatatgataatccaggaaaagcatcccgtcaagttctgggcacgtaatggctcttgataaatggaatttaaaaggagagcctgtccctcaggcagttcaaatctgatctaatgacttccaatggatcaagagacgtggcatgtgggtggaaaagcctgaaggctgggattggtgagtgggacgctcaggttaccaacaggtgtagacaggtcctgctactggctgtggcagcaccagttctccataaacatccatcggttaggatccaccaggccttgaggagagtaaagagggcactaggggacctatccctgggagacctggcataaatccaaaggagaggaaggtgggaaacagggatgatgaacatacagagcacatgtttcttcttttccatttttaccggcagccagtctgctcctgaccagaccagatctcagcctagatcccattcctctttgtactgcatattcccctaaagacatcctaaaagagaatgatagacccagtgaatgcttagtagccacaggtagtttttttgtttgtttgtttaaatagggcctgtccaaagaaatatcacttaaaaaaaataaagcattctacctagttttttttttaatgtagccatatccaaataaagtgtatgatcccttccccacctatctcctccctttcatgttttcttggtttctgcttttctaccacagaaaactccagtgtctttgtgctacgtagaacacaagggatgggtgaatcaaagttgctcagaaatataagctaaggaaaagaagaagtgaattgaacttcaaaactaatagcacaaaagtaatgcacttgatatttgccatggacaggatactgtaaatcagtgcgtgtgctaattggccatttgcctgtgtatccttaaatccatttccctcccttcctctactctgctgtcaatcacaggaaacaccatttgggggctcccttgacaactagcttctagtagttttgacaatcacgggtactagcagaaaactgtaggatgaggaaaggggagaagtcaccgtatttctccctctgccttggggaggcatttccagcaggaagaagctgtgtcttctgtggctccactcccagtagacatccctttccttcatggtcccagcttctgccaggcagccactaggctccacttgttccagcctgagtaactggtttctggaaataccacatcctagaagcagtggcttcctgttcttatatatctttgaattgcctcctctgtccctgattagcttttcaggtcatttatcatctatgtaaccaattccaagtattaaattttctctgtttaaagcacttagagtagtttttatttcctgtgtagatcctgactgatacactggtgatttgaatctattctgctcaatgaattagtagaatgggaaagttaatgtatttaaacagctatgtctctgtgcggctctgaataaaaacaaaaatgcataaataatgtactaagacatttcatcacagcaaaacactgctttggtttctgatatttcatgccatttgcaaatatctccttatttgttattctggggagttttcattagggctaaactatttcacatgacaagtacttttacagcagtttgcaaaaatcatgcactttcccaggttaaaaagaataaccctgaactaaattttaccttcaccttgtgcttcctgacataagtctcatttctaaccaacagaccttcccagcaccctggtgtaaaggaatctacctggcccacaggacaaacgtgccctgaccagctttccacaatccccttctgagctgaaaaaaaatgtattaagtggttaaagaataaaacttggtaattcttataagaattcagacaatgaatggcttataaaatgggccgttaaaataattcatgtctgaaattcagcattaatatgatgcaacatgtcaggtgggggaactgactcctcagagctctactcctaactgcttggctacttgagtaatattaagagaatccatctgaaagaaagggaatagaaatactgacttgttctaagggtagcttaaataagctttgcaaatagcaagatcccactacaagcagatgaactgggcattcagatacctaatgagttagaaagcaattcttccttgatacccagcaccccttcatgcatctagtttttgtccataccaaacttgggaagtagggatcaacaatcgtccttacattctccctgagaggtgggaggagggctccagttctgctctcgtaatccattttttattcagcgtcaccttctctttcaatgggctaagtatcctacaaactggggatgcatcttaattaattctggccaggttcaatggcatttaagagcaggattggcaagtggccttgaaaatgtgctcagtacagccaagttgtacccttgaggacctctatacttaagatgtacctgtgtttctgctccccatcaactgggatccatagatctctctttgtaatcaagacccatactttactgaggttctgagcagctgctcaacgtgaccacatttcatctgccattactttttagtgtcttttaatatgaaggaatgcattcattctgtaagaaaaatgggattagaattttaggaaggctctcaaataatgcaacaataaattcttcaatacccagttgtcagatgtttcagtaaattgcaaatatcagattactttttaaaaatatttcaaacacacacttggaattaaacaagaaccatatattagaaaaggaaataagcttaccttttctattgtaagactccaagcacccacatggatcttcatggtggagattttaacaacactgctaatactgacttacttccaatcagagctgagagagcaaacaaagacaaactctctatggatgtactcatttttttaaacccatatttaaaattaataattttcttaggcattcaatgtgaataataaagctgaactcatttatttaaagttgtaaatttttaaaatagctctaaattagttctctgtgatacaggaaaccagcatgcagaaagccagtaactgcctcactgtttcatccctaactgtgggatcttgggcaagttacttaattgtacttgtgtccattttctctggaaagtgcatatgataacagggctcaccttggttggttattatgaatattaaagtagatgattcatttgattattattcaataaatatgcattgagagtctcctgtgtaacatacatggagcttgccctgttgaacttatggtttggaaaaagaaatagaaattaatcaaagaataatataaataagtgtaattatagctagataaaagctactaaaggaagatatttgatgctctaagaatacatgacaggagactgcacttaatctgtgatgataaaggttaggaaaggttccctaaagaaatacaaaggagatatgaaagattggtaagagttaaccaggctgtgtgcgtatgtgtgtgtgtgtgtgtgtctctgtgtgtatgtgtgtgtaggggctggagtggacatttcaggcaaagggaatagctggcatatatacccaggtttcctctggaaattcaccaccctgaggcaaccactgttagcctcccttccagttatgtttatcttttattttcagctaaataaattttattttgattcaaaagtctggggaattactttgacattaggtgtgtgtgtggtggagggtcctctgatgatgtgcctgtattttttccagagagcccagggcaagtgtgtatgatgcagatttatcctggacatacatcatgggcacatattatcattcattcagaaaatatttatatatttatcaggcacctgcttcatgccttgcattaccctaaacactgaggataaagatgaataagacacaggctctgtctaggactttaaccctcagttgagtgagggaaagagataagaagacacatatttgtattatgccacatcagagttgtgtatgtgaggtaataaattcttgtagcatggaaaatggcctggctgcctctacctgggagggccatgaagactacacagaggaggtcatatgtgagcagaatttaaaggaagcctaagaaggacgttccagaagaacatgtactagggcacctcatctatgtccctaggacctagaagaagagtgcctggcatgtcatacctcaataataaatatctatctaatttacaattggcacggaaagaagttctgtgagttattctgagtggatcaaacatagcatgcaagtaaagggtcaacctgcagagaagtggccagaaatgtaaagagagataaaattgtgaagatgttcttatgtaaggtgaagaatcccagatttgattccctagtttaagtgatggaaagcaactgaagccttttaatcaaggagaatgacataatcagctttgctttatagaaaactcactgtgtcagcagtttaggggatggaaaagtgggagaaaagacttaagccagagagatcgtcaagaagagattatacttgtccagaacagagatgatgaggtttggagggaaggaagatggaaagaatgcatttcagaaacattttgaagtaaaatccatcaagaatacatgggattaaggaagaacaaagagacggggtgatgaagaaatgtttctggcctacatgactgctgacaccattcattgagatgggaatacagaaatgagaaaagggttgagaaaatgcaagatcactttggggcatggtatggataaggtgcatgggtgtatgcatgagggaactgtcctgatggagagaccactgggcgtcttatacagatttgggaatcataaaattgcttcccaggagaaaacagagaagagaaggcacccagaaagcatttggagcccctgaccctggctctatcaccgcccactcctcttcacctcagacttcctggtcactccttcctactcactgagggccctgtggactggctcacatttccccactgcccaaattcctgctcttgctcagccgttctcccttgacaaactagctatcatatcaggtattgaccttttcaggacaagaaaaccagaataaatgccaagagacatcttgccttctctagcatagcatttggggacgcagaggagaggatgtgtgccttacataacttggaatggtggggagtgaaaaatcttacagagaagccaaagactattttatacaaatccacttttaaaaggggaattcttttccacatacaaagaaccagaaatactcattttgtcctccttttttttttgtttaatgtatatgcactcacagttgctaagaattaatactgaaaacatgattttttctaaataactccttgagaaggcacttaaagcctccatttgttatccaaatgtaacatgaggacaagaacagaagaattatttcataaagaaaataatcaatgaatcatttatcagttttcctaccctttgtatgacaaattgtaattagtatgatgtctttgttggcaagtgcttatcaaacaaaatgcagtacagaagcaaaggaagattctgtaaagaactgtgttgttttgaagacctaattgtgatgttatctctggaattttctgtgattacattgttaatttttaatctggtatccttaatagcaacaaggttattagcacctacctagagttctgaatgcccacattagataacacaatcttggcatggtgaacccttggaaataagcatttgcctaagatagaaaagagattcagaaagctctgatggccttggacagggcagaattttgagaaattgaatgtggcagaataaaaagaggttttatcaagcatctttctaaagtgctttcataaattttctctttggtaaagaatgtaccacacccgatcaagagtgttagaattgcttctcagacactttatctgaaattctttactctactttccccaaagtttgttttcactccaataattaatttttgagtgcctactccttgtgatacttgttggaaaatcaaagataaatgggacccagtctctgctttcaaagcactcacactggcatctagtgggaacacaggcctgtaaacaaatggtttcagtatgatgtaagaagcatactgatgtggcgatcataggaacagggatggcagaggagggagacctactcatttgaaataagccacctactcattaatagaatctctgaggattactacgattcccacagagcccatcacaagtagcatgagaaagaccccagggtggaagggggcccttgtgctgccccttctccccttatttagtcagcatggagcccctggactggctttgaacatggctctgaacagggcttaggggataactttcagtgactgctgaaatccagtcatatgactatgtgattttagtcatggctcgtggaaataaatatgctttttttaggagtataaacgtaaaaaatactaacaaaaaatgaagctatttctacatatccagaactattttttttagagacatagcagtctcatcagtcaatattacaaatatgacattcttttatttccatctgcaaaattgttcatgaataaacagaaaagaagaatacacctcatctacccaactctttaaaggttatagcctgctcttagaaacatgtttgtcccttatctcaatacctatattgactttcaataccttctaaagaaccaaaggtctctaataccctcttgttcctctgttttcagaggatgtgtgttaacaaatttaactgtgtaataagttattcttaattacattcggatattttctcctcctaaaggaaaactaaataacaatagataaatagatggatggatgaatggatgcatagattagctagctagctagctaggtgatagaatagatagatgtagatagataaatacatagacaatagataaagctgctcctttgggctctttaacctctttgatcatctttcaataaactatgttaccacttaattagcctgaatgagtacctattgcaatgctgattcttgattttatttatgtgaccactcaacagatatgtctagatatataagagaatataatacaccattcctcatctgtctacagcctttccaaggaggtaattgatcatagtatagatagtgttgcactgtatcccacatcctgttttccctattattagcattttacattaatatttttcatttgtcacattgatacattacattattattaaccaaagttcaaatttcattgaaattgtcttagtttttcaaaaaaaggagagctgttttgccaggtatgtcctgcagaccctggccgagcaatggatgaaaggggtactcagacacaggtatacagtgtaagagcagctaggggactgctgaagagtgaacagtctcgataagctggggctccttgcttttgtttagtacagacataatgccgaaagcctgaagccaacacaatctgtgggtaattaacattattgttcctcctttcagggagcagtcttgtgctggcatggtcaaaggtcagttcctggttaacataagtaaacaagcctgtttacgctaaattcccctacacttccttgtacctactccttgccctctgcctcagggtaagagaacagctgccctcagcttattctcccccaaagctatgcagagccttctgacctttcagaaggtttgcaccctttccctgtaatttctcccaccactctgactgatctcctgcaatgtttaactggtgttatattctaagcttaatcgattgcacacttaaaatgttcagaaaacactcaggatagtggacaagaatcatttcaagtccctgaaacctcaaagtctttagcatatactaaccttcaggtctacatactgatgtgtaattttcaatgcactgtcaataactatcaataacatcatacacacgcacacacacacacacacggccattttggatttgatttttacattgcagttacatatataaaagtgaagttatagattttaaacatttgcatatttcttaaactttctttttaaggatatatagatttgatctctcttttaccctccccaccaaataatggcccacttgacttagggcaatgggggtgtcctgtagttgtttattatgaagaagttgttctcaggcctggagacatgattagaaccagctggggaaattgcttttgagtagcagtgactgagttttactcaggggatgcagctttaattgatctgtgcagtcccctcatcccatctttttataagctccccaggtgactataatgcgcggccaaggctgggaaccactgcattggaaaatgcagaatttatctctttaattcagacaaacatatgaaatgtggaccttgtgtattaacatgaagcctggaagactgctagaaaactcttcgacctcctgctttagctttgtttcccctttgcactcaagcagaattaattacttcctacctaataacgtagtcatgcctcttttattttacttatcatgtagaattataattattttttcagtgcctgtctctccagttagacagttggtttccgaggccgagatcatgtcttgtttatgtgaaatagcctcagcttttaacacaattctggcacatagtagttgctcaataggtatcctagaaagggaaggtgagcataaatcagaaaaaagatataaagtgtagtttagtattaactgaaaataatttcttcttggataagcactcacttctaactacaggaaatgtaatgtagacaaatttgtattttcttgtattctgatcttcgtcagaaataatggcagctatcaatttttttatttaaagaatttaacccagcatctcatttcgggaaataaagcaacatatattgaggtagggattgctaacaagtgaatggctagttctgttaagccataataaaattgaaataatatcagcctgggacttttctctacatttcctatgtcagaacatttgcagtaactgttgctatcaatggatcatactcttgaccagctgggattgtctgagtttccacacacaaagagatggatgggatgctattagttagtctctttagacctgaattcaattttgattgaacatgtttatacttgtgagcttataattatccttgagttcattttaagagatggttttaaagatttcttttttcccttctcactaactactgctgtgttttcagagagatttactagcataaaagatttctggggacattcataaaagggaagaaaatccatagtttagtctgagtctaaaagcataaaccagaggggatgccaggcatctttctactgagtagcttccccgttgatcaatgttaggaagcttgctaatgacactctcatccagaacttttggagagtagggagaaactaacaaaataacagagagccgaggaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaattttggaatcgcctcccagatactttatctagagactctttgttctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagagcttctgttttttatagtgattatatgaagagtaatgggtgaaaagcatcaaagctggaattggagctctggggtctacaccgtttccaatgaatcattcctaatgtgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcctaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaatggtaagcctccgttagacagaaagaaaatgattcttttcactgtgtttaagaggactgattagggcatttcttcagtagtaccaatgtctaccatatgcttcttcctaaacttatataaaaataaatttctgacaaaaatatgtaaaatctaaacatgtctaactaattctcactgcatttctatgcttttcatggaaagagaaaataacgatgaaacttaagagtattgaaatatttatttttcaaaagtaatctactttattaatattatttgcttcttttttcatggttgtaggttcattgcattgcttttttcttacagacattttgataattgttgattttcataagtttgatagaagaatgccattaatacttctcatttatttttcattatctgttcacattaaaataaattctctcttgtaattttcttatgtatacaaataattggaatatttatgtaagattttgtgttttttttttagttttagagtatgaggttattataagggaactgttgtagattaaacttttttaattatactttaagttctgggatacatatgcagaacgtgcaggtttgttacctaagtatacatgtggcatggtggttttctgcacccatccacccattatctaggttttaagccccacatgcattaggtatttgtcccaatgctctccctccccttgccccccaccctccgacaggccccagtgtgtgatgttccccgtgtccatgtgttcttattgttcaactcccccttatgagtgagaacatgcggtgtttggttttctgttcctgtgagattaaatatttcatgatgaaaggagcaaagtgctgtgtctacatgtgaaaaatcaagtttaattcaatctagatggatgaaatacctggaatatccaagtaattctagtaaaattcgttgtttgattattttattcctcccactaccgtatcgtgtgtgtgtgtgtgtgtgtgtgtgtgtgtgtgtgtgtgtgtgtgtaatgttgctcagaaaatatagataaatacttccattctccatcacaatttattgttttgggtgatgcatatcaatgaggttatgattattcacacacaattttcagaatatacaattttatatcctatgtgctgtgtttgttctctgcagctgggaaactgacctggtgagaagaaaaataggtagcccttaaaatctattttagaacaaaagttattttaagatagatgttacggactgaatgtttgtgtacccttaacattcttatattaaaatcttgcctccctactgtggtagtatcaggaagtgaggcctttgggaggtaattaggattggaagagttcatgagcgtggggtcctcacgattgggattagtgcctctagagtcatgagagagcttgcttcccctctctgctctccaccatgtgaggatacaataagagtcacagtctatacacagaagagggctctcaccaggactcaaccatgtaggcaccgtcatctcagacttccagcctccagaactgtggaaaatgagtttctgttgtttctaagtcacccagtttatggtattttattatagcaacccaaattgactaagaaagttagactagtctggaaatgggaccgccttcacctttcccaagtgaaaagtcaaatttcaaccccacccctattattcactccatccagccttcactgagtacttacattgtgctggggactagggacacaagaactgataagacaggaccctgctcattgtcctctgctcattcccctccaaaaaagtctaggatctgaatgcatgccagtctccacctcatccagtgtataaatctattccaaccctgtggttatgtcactgtgctgagagtgcattgtgctatgtcttgaagacgtctgtcttgtacgttttaaaacatgtcaaggttattataaaataaatgcatcaaagcaatacttttgccagctttcaacttatgaatatggattggctttaataactagattaggacactacttcagaagccatttatctaatgtatttttccaaatgttatttcatcaaaaaatttcctggaaatgaacaagatatattgaggccaagatgccacctaaaaaatattcccttttggtggggcatggtcactcacgcctgtaatcccaacagtttgggaggctgaggtgggtggatggctttagcccagagtttgagaccagcctgggcaacatggtgaggtaagactccatctctacaaaaataaataaataaatacaaaaattagccaggcatggtggtgcttgcctgtagtcccagatactcaggaggctaaggtgaaaggatcatttgacctgggaagtggaggtttacagtgagctgagatcatgccactgcactccagtcagggctatagagcaagattctgtcaaaaacaaagaaggaaggaaggaaggaagaaaggaaggaaagtattctatttcaggaaaatagcaaactaaatttcactaatttttgttatttttgctctttattttctagtattttttggaatgtaactggataagttaaatgaaatgagtaatgtaatttgatggaagtatgtagttattttcagatgaataaaggaattaggacttgggtcttggtttccaaaaagagaaaattaaagggtaaaactacataaatcattagctccggaagtaaaggaatttatttttcaaagttgaaagagaggattaaagaagaggaaattaaattgaaggataaagaaagaaaatttaaacctatagaactcctaccaagtgctggcctgaagctaaattccaagttctatgctgtatttcattaaccctcacaacaacctaatgaggtagggataataattcgcatttacaaggagtaaacaaccagtcagtggccaagccagggttcaaaggtagatttcctgaaggaaaccatttggaatcagcgatctagagactaagaagggggaagaagccttttgcactggaatgagtaaggaatgggaaaggagataaagagactagcacaggcagtgctgaacatgaccagttgagagcaaggaaaggagagatttcaaagcagttaagaggaagtcctgctagaagtagacagagcaaaatccaatactgggtcctggatggcgaggaaggtatccttctaaccaaatgaatgaaaacgtagcaaatgcagacaagttcaaggaaggaggggaagactgggaggaagacatttagagactctgaaatagtctctaattgctttgcaaagtaagggatgagatcaccatgtgagtgagggaggatgttaatgggacttcaagaataaagaaaaagatttgacaaaactgagaggcctaactacagacagcttggttaaggattgcatgtacacataggaatgagtttcagtgtgcaagtctgacagggtaggttcacctgagttacgaatggggaatgtgtcagtggggaggcagaactggtgatgtggagagaggagaaaagggtcaagaacgtgtgttcatgcgcgcacgtgtgtgtgtgcgtgtgcatgtgcgtgtgcctgtgcatgtagaagaagatcataagtgagtgtgggtgggtgaaaaaagtgtttaagtggatcagtctaaggagggaccaggaaggggaatggggaataggagcaggaaaggcagaaaagtaagcttgagaactcccaaaccgttttgtttgtaatttgttagtacagtataataatactaaataatagatttgtaattctaagttgtaagacaaagaaaatatgctcgttaaaaaaaaatcttaaatttgatagcaagttagggattgatttctgaaaaacagcccccaaagcacaaacagtaagagaaaagatggatgcatttgattacttttactaatttatttttaattttattaattaataaattaatgtattggttttttaatttaaccaatttgattaattgattaattttaagttaaaatgcaatgtttctgagataaaaagcaaacacacaagccacagtaggaggaaataattataacacatacaaacaagagtagcataaagcacacctaaaaaaaaaattaaagaaaagacaaacgatccattgcaaaaaaatatgcaataacctgaagaggcatttcacagaagaagaaacatgaatagctaataaacatctgaaaagattatcaacctcattagtaatcagagcaatgcaaattcaaagcaaaattaaatatcactttacactcaccagattggcaaaaattttagtctgaaaatataagtactactgaagacgaagagcagcaggagctcttatatgctgtcgataggagtataaattggtcccaatcccttggaaaacaatttggaattaccttgtagttgaacatttgcttacctttctacctaacaattctactcctagatatttccctagagaagcactagtacaggtgtgtgaatgtttacagaggtaatgtttgcaaaaggaaaaggaaaactggaatcatctcaaatatccattgacagaagggtggctaaataaattgttatgaatgcataaatggattttactatggtagtaaaaaaatgaatgaactgcagccataagcattaacagagatggatctcacaaacaaaatattgaatgaaaaagacaaatcacaggaatacatacaaaatgatgccgtttatgtaaaggtgaaaaactcacaaaaccaaatattttgttcatggacacgtacatgcacagtaaaatgacgttgaaaaatattgaataatccaaaaactaaaataacagttactcctgccagggagaaagaggattggaatgtgtctgaatggacaatgctctgtctgttttatttactcatttttaaatttttttagagatgaagtctcactctgtcacccaggctagagtgcagtggcacaatcacagctcactacagcctggaactcctgagctcaggcagtccttccacctcagtcccctgattagctgggactacaggcacagctaatgctctatttcttaagcttggtcgtttattattctatgggcctatgaacacattacctatagtccttcatatatatgaaatatttcataataaatgcaaatcaaggcaaaaattaaaaggggaatgaaaagccaagtatatagaagaaaatttggtgttggtctaaaacataacacatttagtttaaatatataaatcttgtgaccttcactctgaactacatacagaattggctgggccttgcaaagtcgcagtcctttgaaagaatggttgaatatttgaaaaatgggaaaaaaaataaagttagtgtttcatttttaataggtaagaagtactttattataatgaatctgtcagtttaacctctgtacataaagaacacaagattaccaaaacaatgcagttatctctagaatatgttctgtgaaacaccagacgttaaaggttctgtaatcaaatgtgttcaggaatgcaagatactataccccctcttagaaattcgtaagtaagcacctaatatggctgctagattattttttccatcttgaaaattcaaatattaatgaaaacttaagtattctctatgagagatgtagagaatctataaatgaaatctcttgcaaggtctaagaaaatcctgcctcaaatgacatctctgacaatgttcatctcattctttggctcttttccctctgctcacacctcaaatgttagtgttccttaggctcattcctgttcctcttctcttctcaatctctttgcctcctctgcaatctataatctgatcatttcaagatctctctattcagacctcacttttccagactcatactctaaattcatattggaatttctcaagctatgatcccacagacatttcagatttaacacatccaaaccagactctgttacttcacatcctaaaataacttggtctctggattctccattttcatcatggtgtcaccatcccgtcttgttttcaaattagaaatcactttaattggactcttgcatcttcttgcatttattttgccatttttcaggagtgttccttggcttgaggattagagatctttattttctctaatcctttgtcacatcttagtttccagctttattttgtcttaattgggtcattctgtcaccaatatttcccatatgcagttcataattcacatagtattaacataagcatctaatcatgttatttcttgttaacatgaaataacatgttctgttatttttcctgtatggagagcctccagagactctatacaggtgatagacagcctgttaaggtgatagacagtacaacgtgttaggttatacatggagggccaacagatttttggtagtttagaaaaggaagtgaccatcagatgttgatagaagatgatatttctgagtattaacgtatgagtaggagtttgcttgttggatgaagagggacagagacagctacggagtcttgacaatttctctttgtctctgcttctgaactagtggtgaattgactacagaaagtcttgattatcataagggccagtactgtcataaccctaaactttgtgtacaatagaaaaagatgattctgcaaaagaaactatcatcagagcaaacagacaacctacaaaatgggagaaattttttgcaatctttctatctgacaaaggtctaatatccagagtctacaaggaacttaaacaaatttacaagaaaaaaaaacaaacaaccccattaaaaagtgagcaaagggctgggcacagtggctcactcctgtaatctcagcactttcagaggccaaggcgggtggatcacctgaagtcaggagttcaagaccagcctggccaacatggcgaaaccccgttactactaaaaatacaaaagttagctgggtgtggtgatggacgcctgtaattccagctacttaggaggctgaggcaggagaatcacttgaacccaagtggcagaggttgcagtgagccgagattgtgccactgcactccatcctgggtaatagagggagactccataaaaaaaaaaaaaaaaaaaaaaaaaaaaggatgggcaaaggacatgaacagacatttctcaaaagaagacttttatgtggccaaaaaccatgtaaaaaacagttcaacatcactgatcattaagagaaatgcaaattaaaaccacaatgagataccactatctcatgccagtcagagtggcaattattaaaacatcaagaaacaacagatgctagtgaggctgtggagaaataggaacgcttttacactcttgttgggaatgtaacttagttcaaccattgtggaagacagtggggtgattcctcaaagacctagaaccagaaaagccatttgacccagcaatcccattactgggtatatacccaaataaatataaattattctttataaagatagaggcatgcatatgttcattgcagcaccattcacaatagcaaagacatgaagtcaactcaaatgcccatcaatgacagactggataaagaatatatggtacatatacaacatggaatagtatgaagccataacaaggaatgagatcatgtcccttgcagggacatgaatggagctggaagccattatcctcagcaaactaatgcaggaacagaaaagcaaataccacatgttctcacttataagtgggagctgaacaatgaggacatggacacagggagggaaacaacccatactgggtcctgtcagagggtggagggggaggagggagagcatcagcagaaatagctaacacatgctgggcttaatacctaggtgatgggttagtaggtatagtaaacccccatggcacacatttacctatgtaacaaacctgcatgtcctgcacatgtaccccagagcttaaaataaaatgaaaagagtgaaaaaaaaaagaaaaaaagaaaaggaggtccttctaggtgaggtattactaaaaggcaactgaaagaaaaaaatgtttctctatacttaacaacaattctggacaccaaatgtgtgggtttttttttttttttttcatgccgaccgattctccaacaccagctgggtctcctacaacccaccacagttctgacactagctacccagagttagcatagaccacacaggtaaaggcctcagtcccataagactgccctacacttcaaatgccagttgcagacctgggcctctcataatttctgaccaaccaacaataaatcaggggtgcttactacttcctccttgggttggataatttgctagaatggctcacagcacttaggaaagcagtttattcaccattgctggtttactataaaggatacaactcaggaacagccaaatggaagagatccaagggcaaaggatgtgagaacgggagctgtatgccctctccgggtccaccacccttccaaaactttcacatgttcaccaacccagaagttcttggaacaccattgtttagaggttttatggtggttccattatgtaggtagaatttattaaattaatggccattgatggttgagctcaatcttgagcttctctcctatccccttacactggggatgaggctgaaagttccaatactgtaatcatataattggttcccctggcaactagccctatcctgaagctgtctagggagcccatccactaggcattcatattactctggagattccaagggtcttcgaagtgcttgtatcagaaactagggactaaggccaaatattgtaacaaaagatgttcctatcgtccctatcactcaggaaattacaagaattttaggacctctctgccggggatttgggacaaagatcaaatgtttatttcttagtacatcacaatatcatagtatttcttcctctgggttgatggagacagaaccaaagtgcaagtcttatacaaacaggatttcaggccacacacacttccagtctctacccaccccgtagcccagtacctgtgtgtaggggacacgctacacagccataatctgcagctctgattctgactcagcagtcctgtacattatatggccccatgattgccccaaccaaatgtagcatttgcagctcttatcttttgcagctatactatctttggcagccagcctgctgctaggtgacagtttcttttaaactactgagatgagccaatcagtccacacaaacggaagttttcataggcctgtgacagactccaactaaaatgtggttttctacccaaagctttagtgtcctgcctcatatgaagtacaatttcattacaaaatagcaagtgcttcccaagccaatgaggtatctctaagtacatggacctgaggcatgaacatgctgatgtgaatgtaaacaacagtcacacataaaataaattagtcagtgtgcaatgaatttagaaaatacttcaaataaatagaggagactaaatggtatttattcatttaatcaacaaatatttattgagcctctattatatgacaagtattaccctagatactgggaaaacagagattaaccaaataaacaacactcatgaaatttgcagtctaacgggaggagaaagacaacaaatttaaaaatctctactatgttgagtggtgataaatgttgtggataaaagtaaagttggatgagaagactagggaatgccctggtgaggcatgagggcatttgatacttgatataggatcgtcaagagagaaccctctcagaaggagctgttgtcaggggaagatcaaaagccctgagctggaaatgtgtgtgtgtgtgtgtgtgtgtgtgtgtgtgtgtgtgtgtgtgtgtgtacctggcccacttctttttccttcagtgtttgtctttttataacctgtttaaaagagcaatttttatattaaaaaattaaccctttgaattccgtttatgttaccaacgttttcccctcacttcgtcagtgtatttctcttttgtgatatttttgcaccagtggaatttttatcagaattgcactcaaatatattaattatttgggaagaatttacatgtctgcagccttcagtcctcccatttagtaaaactggtggtccagtcttaaaagtaccacaaatttttattaagatgattctttggtttttaaaactatttttgctgttattatgaatgtaggattattttggtccattgtactttctaactgttgtttctggttataagagaaaattattagtttttggagcacagtggctcacacctgtaatcccagcacttgagaaaactatttgtttttaaatgtgtatgtttttgtcttcagccattttctcaaactcccttattcgaatagtttttagtttctttccactatttataaacaattatttcatctaggtataatatttctgtttcttctcatcattaacattttatgtcttaattctactcactaaaatttccaggaccttaatgaaaaaaagataacagtatactcacttttcttgttcttgattttaataacatatatcgctagtatttttacaattacttgtgatgccagcctttagtttaacagaggtgttttttattaggtgttaaagaaatatccctttagtcatagatttaaacattcttatttggagtggatattgcattttgtcaaattctttttggtatctgtcaaagaaatgataagttgtttcttctttaaatggctaataccataaattaatttaatatagggtctattaagatgttttttagagaacactttttccacaggctggtccatgaaaaaaattgggggtggggagattattgtctgatcaaatcatttggaggaaatgctacatagtatattttcttcttaaagattaattagctcattagcatattaaagatactgagaagtccagtagtgaagaattccattaactttgttaaacccttcatttccaaatattacctgtcccccctccttcatatagcattaattagcaccccccttgacttgggttcaatctaacacacttgagaagtgttatattaatagctttccttgtattaaatcatccttgcactcctggaatagaaacgccttggccatagagtgtggctttttaatctagtgctaagagtgctaagttggttaggttttaactgaggatttttgagtctgtaattataagtgggatgtactgtcatttttttgtctctgccttcttttggctgtttctcttattttagtatcagtgtgattctggattggtgatatgtattgggaaatgatccatatttttctgggctctggaacaatttatgctgcatggggaattatcataggattttattttcttaatttgaaatattttctacaaaatagccaaaagagaaatgaacccaaacacagtgctaactggttgtcagtgagcttgtaattaaatcccctgttagctttattttctttactgatgaggcttcaaatgtcttcatttttcctctttgtgggtaaacatgattgctctttgccccaaacggttgacggttcagacagcctaccctgcttagaagcaatcattccttgctcttgtcactccagttcactgcagaacagggaagcatcaaagttaggtcagggaagcaggaaatgatagaatcccaggcaggagaaccaaacttctccatgagtatgttgtccctgaggctgggaacaaagtggggtgacaagtatgaaggcctggagggagggaggcaacagaggcaggtgaattgtgaggtctagaatcccaagaagaggtgaaagagtatcgatcctgttttaaaaacactttctttgaggccgtgttgagagaatgttggacatttacagtctgtaagtggcgacagggagtgctaggtccacttctgaggccagttcctccccaagtcacagaactctttattcagagagatgcaatattattatagtcaaaatacttcacacaattaagggtttaggcatgaaaacacataaaaatggatatataccttctttcctggtatggggattactccacattaaaaagcgaaataccttagccatgcattccagcctcatagcaggcgcccagctacgtgctaggtatttgtgactaagtacctggtgtttgttcaataaagatgtgtgttgtctttccttgtttttatgcaatagatgtgtttctaaaaggtggggcatacattaaaattagagaattaatctttttttccaggtgaggtatatatatatatatacacacacacatatatccttaggcactaaatgtgtctgctttttaatccatctttagttagtgtttctgagcatgggaactttttaacctctccttatcctggtactcttaaggtataataatggtctcagatacttcaatatattaaattttaaaaattattatattaatattcaaaataatttttttctaaataagttgataagttgccagtgttctctatttgtttcttcatatgctgggtagcttgcacctccatctaaaatacaaattgcacataatacaattctttaaccaaatatcggttgtgtttcttttgagacaaaaaaagaaactgctaagattacatgtctctgagttattctctgtaatgtgatgaatgccaaaaacaagaaacatgtatagtagaggaaaatagtggtgatcaacagcaaagtggttccctccactcttctccatacccctctcctcccttcagagaagcacattcatctaagtgaattgttgggaaaaacttatagtccattcctccatccaaggatccctctacgttgcaggcatatgtttaacatgcttattaaatgctattttttctctagtaatgtacagcaaaaaataataataatcaaaggaaaattttggtggtctgttgcaatatgaaatcaggatttgaatgcctgtaatattataaccaacactgagttctttgaagttccttgattctcacaaagctaaaaatcattccttacccttgattagagaaaaatctgattttcctgttgcattgccttcttgaaagagatgatatgagaaagtgccacgatgaattgttgaggttaaatcagacgatattgattttgtgtctaacccagctgtactttctcagttccaacacctcacagggaaatacatacaggccattccacagtaaagacacctgcgacttgataaaattattgggtaaggacatgggaaaacatatttttctccatagccatgcttgcatgtttttctttttttatttttattttacccctttccctgcctcccctttttgtgattgtatagaatatgccaacattttgaagggacatcttgggaggtgaggccggttccctgggaccagattctctgttatcgtgagccaggtcaccatttcattcccctctgttaacagtgactgtagagtccacagatgttccacagtgggtggaggtaataatctgaggcctgtacccaagccaccttgtggcccaggttttaaagttgtgtgggaagcaaagaaacagatgcaaaagacaacatgcagaaagagtgaacacaactcagtgactaatggggcatgcaggatcaggaagagctaaaagtcaaatgacattcatatcctggagaatgaggtgcccccatcaagttaatccattaattaatcaaacattcaggacctggagccattcactctctaacatattctttggctgtattaatatggccattaattcctgaacaacaagcagaaggaaacagtacttaaaaccatggttgagagcacttagtttttcttctctgacgatgtgcaaatcggcagttgcacttttaaaaaaagcctttcatataaatctgggcaccatcctgaatgcatcagtcctattaacagcatgctagttttggagaattgctacaaacccagcctgaggtgaatggcagctgctcttctctggtcagggctacttaaagaagtggcaagtccaaagccatttagaaactgaaaagtggccttctgataaataaaacgacacttctgaagctgaacatcaaggaaagaactttgtgctgacggagaactacagaagctttcctatgggaggctggcatgcagatgtcaccgtggggctttgttgattatgaaactggaagccatagcagtaagtgggtgcatgggggcaaccaaaagcaggaggatggccttgcctgtgtctgtaagacgacttgagacagtagctgccaacagagtcccttaggtgtgtgctttataactgcaggatggtacaaatgacactcttaattttctgagagtttgctttgcagtgaagatttaagacactgagattaatttagttaaattgatatttcccctcgtgatttcagggattaaacagtaaataagcctcttgatgttgatctatctcctggggggtccaataaattacagaaacacttcttgccattttttggagcttcctcttcatttattctccttcctgtggcatactgtgtatggccaggcctttgctacaatttgttatttataaaaagtacagagcacatttcaatcctaccagataaagtcagaattctaactgagctatgggtcaactaactagaaaaaggagtttaagacccaactctggatgtaaatgatgacatggctgtctgtgagggatatggtttggatttgtatccctgcccaaatctcatgtcaaattgtaatccccagtgttggaggaggggcctggtgggaggtgaccggatcatggggacagacatcccccttgctgttctccggacagtgagtgagttctcacaagacctggttgtttaaaagtgtgtagcccctcttccttttctctcttcttcctgctctggccacgtaagacgtgcctccttcctctttgacttccgtcatgattgtgggtttcctgaggcctctccagcaatgcttcctgggtagcccatggaaccatgagccaactaaacctcttttctttgtggattggccagtctcaagtagttctttgtagcaatgtgagaatggactaatacagtaaggcttatggaacttcaagtggtgatttgggttggattcctgacatctccttggtatatccttagacacatcatggagtctctctgttacatcatcgttgagaaaacatcagcaaaatgcttaaaatgttttgggaaaaaatatgttggcagagtcttacttaggaacaggctgcattccaaaattattcaactaatttggacaaattgagtgtctactatgtgccagacatagttgacttcgatagatggggcacctttgccaaaaagtagccctttactggcaagtttccagttagtttgcaagtcagctgtgtataaattgggatacattttcctaaagagacaaattttgaaacagtggttagattctcaggccaattctcagaagctaagttaattcataatgaagtggaactcaacttctaatggaattctcaaacctaactaccatttacacagtgatttttaaccctttgctgcataccacattataacgacctaggaattctttaaaaatttaataaataccaaccaggtgcggtggctcacgcctgtaatcccagcactttgggaggccgaggcgggcagatcacgaggtcaggagatggagaccatcctggctaacacagtgaaaccccgcctctactaacaatacaaaaaattagccgggcgtggtggcgggcgcctgtagtcccagctactcggcaggctgaggcaggagaatggtgtgaacttgggagacggagcttgcagtgagcagagatggcgccactgcgctccagcctgggtgacagagcgagactccatctcaaaaaaaaaaaaaaaaaaaaaaaaaaaaaaaaaaaattaataaataccaatacgcaaactatgcccacaggacaataaaatcagaatctattaccggtagcaatggtggaaaatggaccttaggaaagaatagagaggaatgggaagcaatgcctctagggagatcagggctgtgactggggggtaggggctagggttccagggggtgcagggtgtcgtctggggtattgtggcattggtggctagaataacaagagaagatgcttctggaaatagtagtaagactgtgggcttgtaccctataggagatttttgtcttttgacagtaaatcatttttcaggagtacgaagatgatgcagggggctagaatattcagctccagaagcacaaggattggtgcttcaatgataaggagggagctgataagaacctaagtggtcaacatcactcatcagtttccttttgtccagttcatgaggaatgaaagaagctaccttcaatccaccttcttattttggggtgaagctttcacaaaatgccatgcctcatgtttctcctctgaatatgtagttctttttatcatcttggcctgattacaggcccttaagactcagcagagctaaggggaagggaagggaattgagggaaccaccaagagagctccaaaaacaagagttggcaggtaattctgttcatccacgcctgctctgtaacagctttcagagttcagctcttactttcagtcacttccttgcaacccttgcagtcagaatttcagggttcagaaacataggcctaaagtgttatcaccaagtggtgaaagcaagtttgctgggtggaggatctcctcggctattttgccaagttcttctcatttttatagctgggcatgaagatttccttttttgacattctgtgactgttacaatgtaggaaaatctgtggagatacaacattttcatatttcaagtagctgctctcaaataagggacattttctaagttctactgtttatttttccctggaattttctaggatatattgctttagctctgttttctagttttctctttatgacattttggcttctcccggtcaacaaaaatactgcactggaagaattccagagacatgtgaaagttatctgtcctgcttgagggaaagaaattactactgttttcttccctctgagagagatggcccttaaaagtgttggaatgtatctcttttcttgacattttctgatgttcctgattctgttttcctggtgagggcaaaataaattattgtgaaaaaaaggaggtgaggccctggttctacaggtttctagaggttctggtatggggagggtgtgcacagaagaacttcttccaggtactgatttactgtaagcaacaaacaaacagatcttttttctcatagattgccagccgaactgtgtagcaacactatggaaaagaccccaaccacttccacaaaagaaattcttcccttcactaagtgaggagtttaactcagttagaaaatctggatggacctcaaaggaagaattttctcctttcaaactcaacccatttcaataatagagagaaaaacagatttttttagaactgaaattccttagcaaaatttaattggaatagcattctaccttaatgggcaatcagcttatttagtaggtgagactccattaattttgactgttcaaggagatttcataaccaagtcacttaacttcaagtattctgatggagcagatagctccccatttaggaattttcttgtgctggagtaggaaaatgagagcagcgcctgccttgatatgttgatgatacccttttatttggcaaaggtattattcataaggtagtcaattaatgtcagcctattggaaaaatgacaggctttaaagcttcctctttagattagagactctaaaattctaaatgcctgcagatccatatgtcagttgttgcttctgacctttcctaattgaattagcctccttctagtgagcctgatttaaaaaaaaaattaatagatggggttgctgggggtatcacttagattttcctattgaaaataaatattcccctccaagtagtttatttccggaagtattaagccaaagtcagaaaagtggcaatagcttcaaatagacaggaagtggctgtaaaattagcctttcttaacgagaaggtcagagctgctttatatttttttaaatttcacttttatgtgtggctcattgcttaggctctggctgaggctcatttaacaatgatcccagcagtactggagccctaagcaacaagacttggagacctatcctccttccctggggtgaaatcacctcaaatcattcttaaatacttgttaaaattttcagttgcttaaaagttattttaaatgtaaattttcattttgaaagcaaacagggactcagaaatgatttttgtcagaataagtttgggtctgattctctcctataaccatttctaaaggaaaagcttggtttaattcaatctccagttaagtcaaaaacctaaagaaaagtgagtcatttcatttctcctctaaaaactaaagtgtcaggaaaagttcttttatctgtttcaatatattccaacctgttacaatctttttttttttaagtcataggaaagtatacgaagaaggaatggctgataggtgaactaaaagagaaagccaaaatctttaattacctttatcaggttagcagggaaacaggcacctatgccttaggtagaaaaaggtgattagcattcagaatactgaagcccacatcaattcagaaagggcatgattttaagataagttgaagggtaagttaggaagaagcaactttttaaagcttaagtataaaactaggatgagatcaaagatggattgttaataagagtcaaggattagttggaagtaaagtccctaatcatacccagagtatttaatagactcaattgtgttaaagaagatcttagaggtcatccaatccaacttcgatctttgattgcaaggaacagatgtctcctccagctgacactagccaaagatgggaatttatttaaaagttatataaactaagcactgaaagaaagccaggcctaaagaatgaaggagattccagaatttgatctttatttcaggacctatctctttatttctttgaaaattaatgcatatatcctcagcagcagcataaagctattgtttgtacatgactatggctgaagttctaaaatgtgttttgaatcgtgaaattacaagcacagatctacaaaatggtgatagtgtctctatactaaaaatacaactgcacattttcaatttctctaaaatgaactatgttactatgtaattgcaattacagaactgctgttaatgatgaaagaccctacgcctacctagaccaatcctcttattctaccattagagaaactgtagcctgggaagaagtgatatgttcataatttcccagaggtttaatagtagagccagtagaagaatggagatcctttgatggctgctgtatcagacatgatgctttgtgccacactgggagcagtggccaagaaagaacttagttaagaacctgagttctctagtgtcagactgtcctcgggcaagtactttatacctttctgagccttcatctgtgtaatatggatattagtactccccacaggatggggttgttgtgaggattaaatgagacaacaaatgcacagttattaacacaatgtctagtacatataaatgctctaaaaacaatacaattatcaatcgaaaaatattagctttttgctgcataacaaacaatcctgaaactgaatgatttgcaaaaatatttttatttcctacttataaatctgtgatcagctataactctgctaagcttagctggccgtggctccagttttgggctcatgttgatcccataagtttcctcatcccagatccaggctgaaggaacaacccctaccttggatgcgttgttctcacgataaagaggaatataagaaatgggaaccatgtgatgcttcttaaaacctctactggacaccatcacaatgttgactcttcgcatattatacctatcacagcaagtcatttggccaagcccaaattcaatgaggcagaaaagttaattgcatccacaggcaagctatgttctaggatggaatgaacaatataatctagcacagaaaggttgcgagaaaatctgtggtcactgacacaagaagcttgaataatctgaaactataaactgcataggccatctgtagtagctcaagtcttcaaaattatggactgttaagaaaaaaatcagagatctagggaaggcaacaaagttattttgggtacagacaggataagagggtatataataccattccttctcccagaagcttcaataggtagaggatatactgatttagaggtcatttatttcagtgtttccaaacctgaaaggtatttcaaagggttcatattcttaaagcagcagtggtatgtgtttgcatttccactaattttttaaaagctcaatacatttaacgtttatgtaaaaactgtttccattataaatggaacacatcgagaacccccaggtgtatatggaggaagcctacttggtggtaagtggagattagatgactttgctcgtgatttgtaacttagtttataacacagatgagcactactaggtgcatcctttatcatcatacatttttaattgttttattcttagtcatatgttgtttacatttcattctcaactctgaattaatgaggaatttaatgaaggagaaaaacataattctgtcaattttcttctggatacttttccccagatccataaatttctttcatctgagaaaataactatatgaaacatcaagatatctctaatatttcaaaacataatgtaaaaaagaaaaataaattggtgctatttatgcatcctgtctgtaaccaacaatctattgcagaaataaacactgatgatgctttgaggtctgtaccaggttaggggatagatcagaatgactgtgttcctattatttttacacctcagtacaacatcacaggccattccttctgcctgaaaagccctccttcttctccctcctctgcctaatgttccactcagccttaatccacagctcagctcttacctcctgttggagaagaaattatcctcttcaattccctcagctatatttgttgctctttccccagtattcccatagcacatgcaggggaattacctcctgaatagccttggttttgaaaatagtcactgagtctgtctttctgagttaaccctgagttgagattggggcaatttggttttccagtgcccagcaacatgcctcgcacctagaaagtactcaacacatctttcttgagtggatgagagtaaacggaattgcagcttgatatataagattgaaaactggagaggacattgaagagagcatttcaggaagaagaaaagcacacagaagtaaggagtaagaagacagaggctgagatgcgcaagtttaaggagcaataaatgagcccatgtgactagaccaaagagtttaagaaaagaagtcctggaaaaagcagtggggagtttaggtgtgttgaggagggtctcaggggacacacattgtcttggtctgccctggccatcgtatgtcaaaatatcacatagcttaaacagcagaagtttattttctcacagtttcgggagcttgaagtctaagatcagggtaccagcattacaggtttctggtgaaggctctcttcctgtcttgtagatggctgccctctggctgtgttttcacatggtgggaagagggagcactctggtgtctcttgcttttcttataaggaaactaatcttatccccgtaatctcatcatatgacaactcaccctgctaatctcatgtaaagctaattatctcccaaaggccccatcaccaaatacaaaataccaccagactggggactacggcctcaacatatgaatttgggggaacaaaattcagcccatagcatccacccatattgagtggttaaggaaccggccactgataaatgaagtggaccctaaagattgctatcatccttctgccattattggggttccattgttcagttaagaaagtgaatgaaatctagaaaatcagcatttccaattaaaaaggcgttaaagcctaaggacatgaagaaaataaccttttaatttctgagatgaatgaacaaagaaatttttctaagtggtatcttctatttctatagcagccataaatcataccattgggagctgtaccattttacttttaaatgtacgtttttgaaaagaacacagtcgtttcttattattctccttttgtacaatttcattgcattcataaccagtcaaagggtcctgatgattctccggcagaaaaactatttgttatattcacagtccaagtgcctactgattagcacaggtattttgcattagctgattgggatagaagtacagtcttcctctaagctttactgctttctccattttccattttttgttatttttcaggcctggattcctttcacttggttcattctcttaagaattaccagccacagaatgatgtttttatttatttgaaaagtttatgtccatttgcaaatgattcaagacaagactgagaattccactgcctgatttgcagaaagttgttgctgcctgaaaatgtgctgggcatgtcctgttgatagatagtacaaataaacagtgttaatacaatgggcaaacttcagagcatttccatagctcccgactattgaatgatatacaaaaatatatgacttggggacagctgaaattgtttccacactttgagctctgcttccattagactggttcacaatattagattgaatcccaaggtgctactgataatcatcagctgcttttcttgccaagaatctttgtttaaatgtattctttcattatccatgtgcttttgaaaaaaatgagggaaagaatgcttttaattgaataatctgtattctgtcaggtatttcttctccgtaggaaggtatctgaaaacttactttactttgctgtttttatttatcctgccagtgtagtatattgatgagagaactgaggtccaatagtgttaaaacaagacatgaaatattgattaattcttcttttaaattctctttttacccctgagtataacagatttcagaagctgctgccaataccatgctctccaataaacctccattattggaaggggggtcttgatacccttcaggctttgataaatgattattatgcttttgaaatgttagctttgagtgcctgaggcttgactttcatcagttcaagaaagaaacagtagaactgaagctgcaaagtttgagccaaaggcccccaaaggaaccatttcatgaaaggagttaaccatagatactgtggcttctgaactcgttgtccttgtcccacctgatactttttctgcattcctaattgtacattcccccattgcaggctaagacttgccctttgggtctaggcctactgagtttgctgatttctaaggttaaaaagtaagataatgggtttagatggacttgtaaagaagggagaaggaagtacgatgcttggttggatgaagaaaatcaggggactgtgaatgagcagagtaggaactggagattataggaatctggctgtttagggtcaaggacgccctcagagcaatcaccctaaggcaagaataggccctggggagtcaagaaatccactgccctcttaggacccagatgagcttggaacagaggggaatctgataaaatgtataagagaactgcacaggacagccactgcacaacaaagagttatcctgtccaaaatgttaatagtgctgagattgataaactctaatctagagaaagtgctacaattttttgccatcaaagtatgaatttcttgagttcagaacccaactcattgagctattggtattcaataattagcagagcatcctgtgaatagataataaatccaacataatccagttctcttttgaaaagtagccatttccatttcctcagttcctcccctgaaattatctgaaagggaaatgtcactcagttagaaggctccagcttgccagataatgggaggaaagtgcttcacgatatctttccagaaatgagaagaggacagagtgtgctcagaaacagaggtacaggcaaatgaaggttgctgacagccaaaaacactgagactggtaaacatcatgatagctgaacagacgaggaatccctgtatccatgtgatggcctttcgacatgaaggaataggggtaaacatcaagggtaaagtagcttatattttattgaaataaactagatgaaaggtcgtatcttaaatgatatgtcttcaagcatgtgctacatcaaggtcttgacggcatcattttcccaagagatatgccagtaaatttaagtagtttccaagttgtaagtatcttgattaccaaggagcagcagggtgcagagcctgaccggtaaaatcaaaggattgatggcttcctcttcacacgcctgcctttattttcccctgcatggcccattattctgctgcattaatttaagctttcctattgcacagaattaggggcttaaattctcttatcatccctgtgggaatcttgattgtttatttgtggatgagaataattgtttttattgatccccaaatgtggaaggtaaaaaaaaatgctatggttgatggccagctgatacatagttagtgctgcgtgcatgagtgacaaattatgagacagtatttggccccagaggatatcctttaagaatttttaaggcatttgatagttatcactttaaggcatttgatagttatcactaagtctttccaagctggaaatcataaacaatttcacatacatcaggtaaagtctttttgttgtagttttcattgaaacttaaaggtctagttgtgtgtaatttataatttctcatttccagtatgctcacacagcaactcggtagagtttggaaatggtacggctacaagacattctggagccagtgctatcaggccagtgagttcctctagggacccagattactaggcatttatttggaagaattcctggattcatccagaagttgtcattattccactgcaagcatcattgtatggacattagctccaaatagttagagaaaagaactactttgctagccctagcttgtactgtgggtaggaaaccccctgccatttaacatcccaaatatatcagaggcatcagggaaaggaactgcaactgtcaattaagtgctgtttgtaggacagggcacttgggcagtatgagcctcccccatctgaatcaaatgcaacacatcttgtttaaagagctattgagctaattagcatggcatgtctacacagaaataaaacaaatcaggttaggtcctaaaggaatcaagtatcagaaatgtggtaaagtttccttattaggtggtaagatggcaagatccttgaccagatgccaaaccctgaaattcttgatcttcttttcctgtgctaaagagaacatagatatatagagaagccactaatgaccattgtatcttctttattctttgagggctgtgttctggaagcttactgttgaaccttcagaaacgactgtgtgggctagaccagaatgagtcaggagagcttgcttgtttcacagaataagtgtccatatgtcacaaagaggatcttcctctttttcctggggatatcatattatctttgtctttgataattagcacctctgtgaagggaccacatcaaagggaggatgatttttcctaattatgatttttttttctcactcaaattcacctttacccttagcactatggttcagttatggccttggccttcgtcagccattgcaacaccttccatgagtggcagtgtaaaggagggaatcatggagttctccccacaaaagttttgtgactattgtcactaccattgcaaggtaaaaactttatacccagcttatatttttatatataccccatacatttagtgtcatgcccatcacacaagggagcatgaaatgtgatctgacgtattcacatgtttgctcattacaacatccaatatgcatagagcatggtaccgcacagtggttaaaacttaattacagactgttgagggtgatgatcacagaatcatagttcaaccatctcattttagacacaaggaaaataagacccagagaggctaaataagtggccaaagcctcatgttcgagtagcagcagagctgcaatatgaaaccagatatcctcactccaattctaactgcactctgtgttgactctgaaacacatggctgtgctttgttgcactgtattgtgatcaattgttttaacatgtgtgcctccctcactagaccatgtactcttaagaaaatattcatcaccagcttcctagcacagtcagtggcacataataggatcccaataaatgttggttgaaaaagtgaataaatgagtaaatacatgagacctgattttttcctcatcatatagaaacaaacaaatgccgtaacttttagtgatctctatgagtgcttggtcagcctgataatgaagaatagacaagatagggagtgaaaggtagaaaaaaatagtatgagaaagaagagaaaaaaaaagaatatacaattccataggaataataaccagacaaattcagtacatagacaaaatatttagattcaatttgggagcattttgtcaagactcttgcctcttctgatctcttctcattttcaaataagggctttttaagcagatggtgctttaagcaattcccatcattgctgctcctcctcaaaccccagaatgcaggattgactgcaggttaagttgtctaaaaggcaaagttgttcgttactgtagctcacttccctgagatacgtcttcccattcattttgcatctattgctgccccatgttgctgctactgtcacagaggaaagtgcatgtaactcactgtgatctagtttctgggatattttccatacaccagaagatgcgaaggaatggctacttaggtagtaacatttcagactcagtgacaagtatgcagagaggatgtatatgggctgagtctgtgtatccttgtaaatcacccaaagtcaatgcaagtaaaggctaaaaaatccaattatcaacccccactgtgagtttgtgtttttcctgaaatgctggcacattgtaagtaatttgacactaagtagtgcctgttaaaaagaagcagcagcagcagcagcaaaggattcaaggctcctaattatagcacactgatggcttggtactgggatgtgcatcaacaatattgagcatcagtagggagcaagtactggctggagggctgtatccagagagcggttatcagtatctaagtgtcagtttgaactggctgtgctcctgtaggccaagaagtctatatggaagatagaccatttaatctttttcagaggtgttgctacacagctatcaaacaaattggggtgctccaaatgcccccgtggagagttttaaggagatggacagtcatctcttttgaatggattgagtcacactggctaaagacaaatatggagatccagcttttcatttaacattcctttgaaccatttggaacttggcagatgcccaatcagcacttcatccaagtacatcaccaccttccccttcagttcctgcatttcccagctcttctttgaacataccaaccatacttccatatttgtgattttgtccttgcccttccctcttcctgaaataccttttcctcatgtggtccaagtggcttcttcctccttgaccctcccctctgtctttttcagatctttgttcccatgatcaaagaaggctttcctagccaaactttataatatagctacctccaaatccaacccactggccttcacaaagacagaaggtttggttgttttgatcgttgttgtatccccagcctccataacagtgattaccatgtagcttgttcaatggaaatacaatgaagaagttggtaacataggtcttaaaaaggaaaagtcttgtcttataatgcctggaaagcagttaagaaatcttttcagatgctttcatttcaagttattcacatacactgcatgtaagttacacttagaaacccaagcagccttcaagaaagtagtaatatgtccagttaagcaagatagcactattatcattcagttcccatctgggctccaagcaactttaagagaatctttcctctgatagacaggactaatttgtgtcttatggaaaattaaataaattatttttcacctgaagggataagattatttgacttcagatatttgctatatggcttctcttccacacaacatagctttgaggcttaaggtagtaagagcaagagcattcctataaattattcagagataattcaaaacaagtgtgcatctttgacatattgtcaagtttctcaactctttttcctgataacaagtgctatgtttttgatgaaatgttgctcgtttctcacacaccttattgttctgtgtgtgtgttctgtgttttgttctgtttgttattgtttgttttcatttccctcagagtccagtctggctcatatctcagcacagggtggtttaccttccttctggccatggacgcctgttatggcattcacgtctacgggatgataaatgacacctactgcaagtaagatcacaagaaattatttttatgcagctccaattcggagatcttgtcaaaatatcacaattcattttaataccataaatctgagaaacagataaagcaacaattatttcccagtgttctttgctgacatgacattttattgtcagtgcgtcaagttgtgacttctaggggtgagaaaaagaaaaatatttaccagtctaatgtcaaatgtcaggaggaacacttttcccttaatcagtggcatagcagggacttttggcttgaaaatacagaagaagtttagtggttgtgtaatttgcaaaagcaagtttgtcatttctgctgctctgatggcttgatggatagctatctactcaatggttagttagatttgatcatgaaggacaaaatgtcctgcagcctcagagaaactgacagcttaacaagaattcctggaaattatacttcactagtaagtgagtaatctgccagatccttatttaaaatgagtgtgtttacccacagtatatccttgctggtgggatagtttctaattagataatgaaacaaaccctccatgcttcatcaggataatggaatctatttccctaccaacaattggcacaatataattcacagactgttttaatcataatgtcaaaatggtaactctcagccacagtcttcatgaacaaatatttcttccctaactataagcataatggagctcagatgagccaatatcttactgtgaaaaatcacagtttcttcaagttctgcaagaggctatctaaagtttcttcaattatacaccatttccttttcaaaagatagccatatgtttgaatgtaattggcatgatatataaattttatttgatctattaaaccactaaaaacttggtacatcttcctaaaagctttcatacatataatagcttttaactgagttcatggacaagaatcatgtatgggtttgtgagtaaatgcatttactgggcacataatggattcttgtaaatgagtgcttcattcttcatctcaatctttctctccttttctttttttttcttttctaggacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagtttagagggtttgtgagggctagaccattagaggaaaaaaatggttcaggcaaaataaactgcagcagaaccccaactgttaggccctctcccctgggtgttcccatcagtcctgcatggatgcatttcaaataccaactttccattctaatcttttagggcagcatgtaaccaggcctcactgagaggagaaatccaagaagagtgtagagaaacacacatgagaggaacctcacaataaaaaggaaacaaactctgggaaacatggttaagaaatatcagactcaattaataatggaggcttcaacagccttggagagatccaatacaaactaaattcaaactatatgccagtgcttctagccatatttactttttttttctttttttttttttgagatgaagtctagctctgtcactcaggctggagtgcaggggcacgatgttggctcactgcaatctctgcctcccaggttcaagcaattcttttgcctcagcctcccaagtagctgagactacaggtgtgcgccaccacacccgactaatttttgtatttttagtagagacggggcttcaccatgttggccaggctggtcttgaactcctgacctcaggtgatatgcctgcctgggcctcccaaagttctgggattatagacgtgagacacagtgcccagtccatatttacttttaattgattatgtttttttttttaaaaaaaaacttagaggaaaactctttaagaaaaacaaatcaggctaaaaactacattcttctaggtaatgaaaagtaggcaaacaacattagttttggattttttaaaaattaaaaacagcttttcttaattggttcatttgaaaaaaaatggaaacttccaatagggaaaggtagagctgagatgaagttaagggagaatgttactgaatgggaaaatatataatattttaaaaatgcaattttaaatcatgcgtaacttgtcttggagttcatcccagataagtatcagtatagtcagggatgttgacgaattctggattagaagaactgtgcaaaggtttgaaatagcagtaagctcaagtcttgggaatgcaaactggatgacattttggaatgtcctactatcgaaaaggagagaaatgaagcttaaccccatatgtcagtgtattctcataaacagctacctaaaagggcatagccaagatgcagttaaacatagctacagacacacgtgtggacctggacagctagatgcctgctttaggatatgaaaaatttcctaggtcacaattataacagtgcaatgatttctagaaaaagaagatcatttcctatcctggctcagaatgttaaaaaaaatgactttcccataacattttctaatggatcttccagtcacagtctcctatggaggcataatttatgtagtggatgacaaagagttttatgatatctggaattcatttaaaatctttagattggaaaaattgagatccaattaaaatcttaataaatgactctgtgttgcatataaatatattaaattaatatgtgtgcaggctgaaattggaaaagttatgagagtcagcatgttaattctatttctatcagggaactaactgtatgttataactctgagaattattgggtaatggggctgtttacaatgaggcaaaactgaatttaaatagcaaatattcacccatgacttgtcataactcatgaagtctccaccttgaggcatggtgaaatctcactagtgaaaggcctctgaggagagggaaggtggaccaggaagccaagaagagccctagggaggctgatgtagtgaaagggccaggtccaaggatctctccatgaaaggaagcaaaggctggcaggctgctctgtggcacccccacgtagtaggtgagatgcagcagtgagaatctttgattggaagtcattctcatgcacagaaggtggtaacagcttggttggtgagagactgatgagaagtgctgggtctttgttaaggtatgacccaggggctgagggttgaaaaatacagggtgagtgtatgtatccggtacactcagattgatagagtgtacctatcctctgcatactcacatatttaccctaggttttgtatcctagtctgtatcccggggaggattcatacttaccctaagttttcctatggctacactaagacaacagatgaaatgtgaagagtgacaaatgacagaaattgggcttctaacatactggacagctgaatgtagcagttaagatggcaaacccacaagtccctagattcaaacccctgttcccctagttaccagctggggatgataacatccatgtggatgttgtgaggatcaaatgagatactttctttaattgcaggatgctccattttgttattattatttttggaaatagaaactcttggctttaagtcacataatgttagagctggaaaattatgctacacctatggatttgactaagctgttcctgtagtttggccagttttaaaacaaaaaaatcctggcaacacactcctatcctcccagccccaacaaatctggctatctccattccctggtaggttcaaaacctgtttttatttccatccaaaagcttcccccccacccccagacatcgagtggtccatctaaaacagtgattgttaatactgttttgtaaatcttccagtccagatttattctagaacttgagtttgtttttagattgttataaatgtgcctttatttctagctgtttgacataacttttggatgttaataaaaaaaataacaccttgggaagtatggacatgggtggatagaaatgtaattgagaaagccatatccaagtagattgagggaattagtaaaggcctcatcacggcatacccaagtcataacatgttaaaagtttgctccgttggtgttcatcctcctgagacacccaaggctgatggcaattatcctattcatcttctcccacaagtctgtctttagcggaagatttttttctttacataaagagctatcatataaaaagtgctcatagtgccagaaattgaggtaaatgcaatttgcaaacattattatctcatttaattctcttgaggatagataatattagataaggtaaggattaaagagaggttaagaaacttgatcaaggacacccagcagggaagtacttagcagggctgttcactagggcctgctgtttctctttccagatgtacagactttctagagagaacgatgtgctctgcccaccctcacccctttgctctgctgttctgccagggacatgcaggagacggaggccttcctcttaaccgcaagaggccttccttttttactaatattcctcagcacagaccctttacgggtgtcgggctgggggacggtcaggtgtttctctttctccttcctgagatctttgcttccaatttggctaaggccctttccatgttatagtatcatgtatctcttattcttgtctttctcacttaactgtgagcccaccttgatgttagatattctgaaagtcattctcctatccctgaaaggtcttcaataaagatttttcctccacttagtggaaggtgaataaagtttattcttccatttagtagtggctcaataaaaaagtttgtggaatcaatcaagggatgagtaaatgaatgaaatactgaattttcctggcctatgaaggaccatgagctaaagcagcggtttaaagtatatagtcccaaacaaagaattcttactaaaaacacaccggatctgtaaggcagaggagggaggggcgggaggaagaagtcgaagagcagggtgtggtattccagggagactgaagacaggagcttcccatgggacaggcagttcatccacaggctcagcttctgcaacctccttcctgtggttactcctgctctctaagaattctgcatgttctcatcaagaaaataccaaattccttgaaagcctggattctgccttgtggtttgtgagccaatctcatgacaccaccagcccacagtgcttttcctgattccatggaggcaaactagacggagcttctagcaagtgaaacttcttttgggtagatatttgggggccgcttttaaaatttttctgacagaccaagtggtaaaaatctgtgtgtgtacacggaatgctctctcccttctgcaatgcgtttactctccttgtagaaataactgcttctcttagccggctcttgcttggagcagggaagagcaaagtcctatcatgtacacatacacagtttataaacatatactgtacaatcaacatgtacatatataatacaatatacacatgtgtgcatcctgtatctgtatactgtatatcatgcatatacaatttcataaacaagcttgtaccaggaaaaggcaataatttatatattatacacacatacatgtatatgtaaaatatgtacacacacacaaaatataccatacagagtgtaaggttcatgacgtctttctttcgttgatatttgtgctcacttattagcggtaaattattaattttagataagcccatcacagagtgaaggctcaatccttgaacagcccagggagaacttcgttgctacttttgaaaagccctttgatgtgcccaaagtctccagaagggcgatgccaaacccactcaactttgacaaagtgtgaaacgtctgtaaaaaggagttctctgatgtgtgagaggagacggaaccgagaagaaaaggccgtactctgccccccgcgggacccaggtccccgcctgctgcagagcgcactctgcgcacgtcgagccgcgaaaggttcacagaagaaaacaagagaaagaagtagcaggcactgaggagccgccggcgccggcgcccaggacggcacgtgacccgggggcggggccgcgcgggccgcgggccagtggatggggacgggggcggggccgcggctcggggggcggggtctgtggcggcgcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaaggtaacgacttggatctgtggctcggacgcgtggttggccagccccttgctgctcagaggcacggagtcagccgcggtcccaccgcatcctcatctcagttgtcttttcctggcattgattttctttttgttcctttggcaaatgcatatggagggagattctgaaacatgcagctggcacagcttcttttcccaccattcctgcctcctgctcgcgcctgcattgaaggagctgcagactgttggctccaggggagagcagggctgtgtgccgaataatggggatggtagggagaggaggggtgttcccgcgggtcccgcggctctgtggagcctgaggcctttcaggggccacggggaggggtggagtggctaggcgtgagttgctggtggtgaggggcatagcgctttaaatggagggaagagtgagcggaggtgggctctactgtgcatttgatcatgtgaagacagaaacttctgagtttacaggtagtcccttaggaatgagttttctatgagatctgctagctctgtttgcccttagctctactttggaaaagttcacacgaggatgtatatgttagtagagaacctctcactctctttatgctcataaatttgaatagacaaaatgattttatgctctgccagagtgcgctcagccatcccttctttgttgagttttctttctccaagaccggattcttagcctcacctgagcatctttctgggttcacagacttgtggcctcaggtgggagaacttggtgtgagggcctcacttaaaaagaactttccatcccactggtagaggcctcccctgccctcgtttttttttttgcactacctttctacaagaacataacctggatgcatgaatcaaaaacatgaacagcatgaaagtttcctgggccttgactggagaatgcagagacctagttgtccaagcctgggggaactgtgtgacgatggaaaataccaggaaacaattcgttgttgttgtgttattgtgaagtagcatttatttctctataagatgatattaagtcatctactgtgttctggttacctgaatcgtcttctaacgtgcctggtgtcaatgatgaaaataagagactaacctcgtagaagttgtttccccttctttgcgtaaaggagatcagaagtttcctgtgagctttctgaacttcctctttttgtttcagaacattttccaggacatgaggaaataatacatcagtattacagtatggggtatttgaccgggaggctcttagcacaaggactgaaatatgaatatgagtcatctttactattcattgtgttatttgctgaaagggacattgaggagcatgatatttattgctggccatctttttctgttttggtttctcccctgccttgtcctatacatgtggtaaacatctttaatgcacatcccaaactacacatgaatctggtccaatctttctcttctagcacttcacactgctttcagacatttgggacatatctgtccaccttatcttccctccactgaaactaatgtgggctttagactcagaaagatatgtctggatgctggctctgcccactgctacctctgtgatgttggacaagttacttaaatgtctctgggccttagtttcttcaatataagatcaaagtagtggcacctgcttcacaaggttgctgtgggaatgaaataagatagggtatgaaaaatactttgtggcacaggcatttaatatgtgccatttttttcctctaacatataataataagtgcagtttggttgatccttactatatcctcagtctgtttcttataactattattttttataaaatacaaaatgttttttattctttaatctttacataaaaccctgaaagataagtatcattgttttaaaccccattttacagatgagaaagttgacgctccctagtttaagagatttgcccaaggccacacagggttaatgacagagtgatcctggatttagacccagatatgtcaaccttccatatactttactgctgttccagtactttcccaggtgatgacttttaagatggcctaataccattcagttccaaccacctttgagcacctttgagcaatccccttctctggtcatggtctagacagtctgggctggatcttttttctttgttgtctttgaaaagctacacatggagcagtgcagaatacaggtttcagtccagagacctgagttcagtgcaagcctggcttcttgcatatgattttagacagctgctgcaacctggagcctcagttttcccttgttgaagtgttcatagaattataaccattgcgttacagggtttttatgaggataaaactatggacttttttttttttaatgaaatattttctgccatttgctgaccctggacttggtgttggcatatgtagaaaaggaaagattttcctctgccctcttagtttctgtgcctggtcctgatagctaaactgacaaaaggcatattaacagaggaaaaacatacacattttatttgatgttaatgtttttatgtgtaccacagagggcttcctatataagaaataaagacccgaagaaggggagaggcctgagagtttataaagcattttaatagagaaggataaattgtggaaatgtgacaagacaaaggaaaaagggggtttgggctggggcagtcgattgtgagaaagtgggaaatgtatggggaaaactaatggaaaataggtgagtgtttttactagagatttattttggtgttgactctccatctttgatcataagaatgttctcctcttcctggcacagggaagggacatttctcatgggaaattttatgccttgcttttaggtagaaatggggaggtcagaaagcccttcctgtatctgctttttctcaattgcctttagctcaaaataatcaatatgccaaagtgatatattttggggtagcctgttctgattccttttacatcacaagatgcataaaccattgaccccattctcaaatggcttatggtttagtaaggatgatagaaaagtaaatgagtgcttaggttacaatgtgaagaataaaactacataggtccatggagggcatagtagaagcatggaaggagagagcaattacccctgtcattgggtagttcagacaggcttcccactgatgatattggagttgtgttttgaagactaaataggatttactatgacggagctcgtgttttagaaagataagttttgaggcagtgccaactttgttctgtgggctaagactttaatcttctcaatgaattttgcagtagattttactatccatttttacaaatgagaaaactgagatagagagatattgattaaagtatcattattgcctacacaatagtgaccctcactaagaagagacccccatgctgtggcagctaattttggtcttttaggggatatggaactatcccctcaaggtgctgtgcatgctgagggcccattctgccaatgcatagcgctagttctcgtaacagaacgatgatcacttcataatcatttaatttaggaattcagacttcacattgcctggactttaaagccagaaatatgtgacttttaattatggctccactccttattgattatagagccataacaagtttcttgatttcactacctcagtttccaaaatgggaatcatgcattcctcaatgggttattctaaaggttaaatgagataatctgtatattagttatattgcagggggaaaaaagaaactctgaatcttagcaggttcatttcttgccatgctcctggttaggcagctctcctgtgtagctctaccattgaataaagaatcaactcaaggaccagtctctttattattattatttttttttgagacagagtctcactctgttgcccaggctggagtgcagtggcgtgatcttggttcgctgcaacctctgcctcctggattcaagcaattctcgtgcctcagcctcccaaatagctgggactacagctatgcacccctatgcctggctaattttttgtatttttagtagagacggggtttcaccatgttggccaggctggtattgaactcctggcctcaagtgatctgtgtgccttggcctcccaaagtgctgggattacaggcatgagccatcgtgcctggcctaggaccagtctcttttcattaagcagctctgatgtcttcttgggccccagagcccttgtcagattctctgttttcagcagctccaggagacagattacagggaagatctcgtggggttgtttaaaaagtctctcaaatttgatagacaggaaaactctttgctttaatttgtatttatttgatcattagtgaagttaagcttttaaatttgtattagtcatttgtctttcttcttttataaattatagatactttaaaattttatgcaagaaaatctatccatattttcttttatgatttctacccttggtcagcaggtacattttcagcacagtgtcttgtacactttcatttttaaaaaatataggtgaattgtattaacttttatattggaagtggacattgagtggacatgtagacacaagatccttgagaatcatttctgccttcgagaagattatggttttgccaggttgatgaggcttatgaacatgaagcagttagctgatacgatagatgcatgactaagccacaattaccttctctccagtgacctgtcctcatatatttatcttgattgataggtaattagatgaatgatgataccaagttaggaacttggcgtcttctcatttcctcttcctccccctgccccagatctaatccttctccacagtgcatcagttctgtctcaggaaaacctctcaactctgccccttactttccatccttactccccctgccttgttcaactcccactttagagtcacatctgtggtcaggccatcccctgcctcagcaggcttcctctgtgctcctgtggtcttagttcttgtccctgtagtagcaggtattaccatgtactgtcaataaactgctttcatgcccagctcttctttgactatcaaatgttagggagccgcggccttccagtgtttactgagcatctgtaattgagttctgttcttaccctaagtgagattatagactcagtgagaaggcaaataattaaactagtaattaaaagtatgcgaggagtttgaaaattacacctcatggtatgggagtatatgggtggggtgttgacggttactgaactgaatgtaaaaggcagaaaaggctttgttttattcaacttggtatttctaagaactagcttggctctcagtaggtgatccttaagtgtttgctgaatgtatcagtggtgttattaatttttttttatgtcagttatagacacaggtccaacctgtcttctgaaaacagctgagcatttcaaggatgtggcatggattttttactctaatgtatagcaggcagattagagcttgttgattagtttgctccttaaattttttcttagtatgtttcttgtaggtaggtctgttaccattcctcatataaaatctggggccaatttaagatctggggttggggggatggggagatgagagaactggactagaaggagggaaaaagagaagtgtaggcgtggtttaacttttgtcatgatcattttggttccccagattaacagaaacagataaaccaaaaaaaaaaaaaaacaatcaaaaaccaaacacccacaaccaaatgattgtgtggttctcaaacgatgaggtctcaaagcatttgaaaacagtatggcttcactgagactggaaagccacagggacttcacaggtacacagatgataaatctgaaaccgtaggataaccctggcaagtagacaagtcacttcatttaataaatctgctatgacatttcttattgctgcccaggaaatgctgaattctcagcagctgcctggcctaatttccagtcttacagtgactgagcagatgcttttgctacgtatatcagcacattgtggggaatgagtggcttgggtaaaagtagtgctctttggatggattgataacaacagcaacaataggtgccatttattgaacagccagagtgctcaggctggcttctgtgctaagtaaacttttattacaaatgaagacactgaagttcagaaaacctaagtaaattgtccgatgtcctgtggtcagtaagtgatggaggtggggttcaccctgacttcgtgtggttgtaaagcaggggtgttcaaacttttggcttccttgggccacattggaagaagaattgtctgggccacacataaaatacactaacacgaatgacagctggtgagctaaaaaaaaaaaaaaaaaaaagcaaatcgcaaaagaaatctcataatgttttaagaatgtttacaaatttgtgttgggccacattcaaagctgtcctgcgctgcgggttggacaagctatagagcttgtcttttaccttcagtgccaatttagtaaatatttatagggattctgaatttatttcaccatcttctaccccagacaatatccagtctagacaacttcctaatctggtggcctgatggggaccacttttagctgtgtcgtttttatttgttcctttaagtttcctttgtgacagaagaactagaggaactagaggggctgcaaagactgaggagataagaaggctttaattctgtttaattctgaatagatctttgaccctgggcaagttatgtgaacctatgtgtcctttttgggggtgggagtgagggagagttggatttaccctgaacgcaagcttcagggcccttccaaggttctgggaagagacactagcattttggtatttataattttatattcattttatcaaggaatcccacaaatcgtatacatttcaggctccccaacatagatctgtcccttgggtggtgttggagaaccaaagagataatgcttgtgaatgcactttgcaaagcagagtgcactgcataggcatgaagtggaaatggcaaaaaacgttattagtattattagtactgataatagctggaatcgaggaaacctttgttgaaggactagtgggagaaagaaggggtttaggtctgaggaaaacagggaagcctattaagctttctagtaaacgactgagcgaagttatgaaagcttctccccaggagaaaaatttctgtttgtaagaatttaacacacacttatgcctgagggctgggagttgaatgaggttcttttctgtttcctggctttagggaacagtggaggaaggcatttttctaattggagggagtagatttacaagtgctacctggatcccattaccaaaagctgcagttagctcctggttattaaaaggctcattattcagtttatggattatccagaccccatttgcctccagccattctgatgtacacgttttatgccttttactgccaattagcgccttcacctgagcagagaaaaaagggggtgctaaaccccaaatttgttaatttctctccttgttagcagctctgtaaaggtttgtcagcaggagagtgggcctaggaaaaggttcaaatgaggtgaagggattatctgcgctttctctattgctgtttctctcaattcaaaaattgagactaggctctggttctgactgtaaactgatttaaagtcactaagtcagagaccttggcctgggatattaagagactttaataaacagcagccctagggtaggtgacattctttgagaagccccttaccccacactccatatctccaggcctctctttcatttcctgtgtgatgtggaggtgtgggggccaacaacatctggtacttgagagagtgagggagaatttactcctaaacagatttgtcggaggccagaaaaagaggatacttgggtcgttttcgtgttttttgtttttttttttaaaggtgtgtttctctgtgcacacatagcaaatataaatatacatgcacattcattcaatcttatcttaatatttactcagatttgaaaactatcgcacgtaaaatccttttctggaagggacttctctctgatttcaaaggctatttggtttcttagtgaatttattggctgtgcatttactacacacgaagtaaaaacttctttggtcagctatggaaacgatttgcatcttgctctgagaagatcatgatcacaagggaattggaagtaaaatgtgtatattctgggttggaaatgagtcctgatctgggattaaaacctggttgcaatactcatcttagattttgagaactagaatgagcaaatgactgtcgtgagttgatccctctatttgggactagtgggatatgcacttgcggtgagcagggctgtgattcctggtgctgtttgctgcgcggctggccgcgacaatgggctggactcgaaagaaagagaagtgaaagtctctctttgtgaagcgtttgccttatcagagaaagtggtaccagagaagagacacgagaactgctctctagggtgtgggcagtaagaagactgtggggtgcagaggtcagagctagaccgactctgagtcccatcctggctttgtgattaatatgaataaaacaataatacccttatttcatggtctgtagcagtgctgtccagcagaaatataatgtaggctttttatgcaattgtacatttcctaagagccattattttaaaaaagcaaaaaagaaacatgtagaatttaataatgtgttttatttaacttggtatatccaaaatactttcatttcaaaatgtactcaatataaaaattaatgagatatttatatctttttttttacaaacagttcttaaaactcggtgtacgttttacacttatagcatctctcagtttgaattctaaatttttcatcagaaatatttgatttgtattttgattttactaatttaaagtaaaaaagtaggttcactcgtctaagttgaattgtgcttagaccttttccagtagctgaatggaacattatttttaaaaggtaaattaattaaaatgaaatgaaattttaaaaatgtggtttgttggttatgccagccatgtttcaatgctcaaaagccacatgtggctagtggctactgtattggacagcatgctccttcaggtattcatcttcactatcagaagagaccactagactcagacaatgagagtagcgtaaggggctgcagaaaggattggctgctgggtcaggttcagatggggaggacacacctgttggctggactcctggcagccaaaggctggcgactgatgagcaagtaatgagtgcctgactcagggacacatctgagcgtttgatgagcccttgaaattttatctgaaaatgcagtcctcagtttcaccatatcctgagcctaattttaccccagatgttgtgcagctgtgagttttcccaagggagtgctgctttgtggtatgtgtgagttggctctttggtctcagtgtggtagtgtgaactcctggaggctttgagggcagacacagacttgaagcacttttatttgagttgtttcattgctccaggagggtattacacatatgggagcaatttaaatgtccagaacaaaccacatgtcttcttttaagtccagagagcaaggtgattgcagtttctttgttcggtttgcttattttttactgcttatttctgtgtgcataaattcagcgacatgctaatagacatatggccaatggtgcttagagaaaatctgtttgtaaacctgaatctctgttttgcctacacatttgcattgtattcctgccctgctccaactcgttgtcctagaccatccagtgttagcatttttctcatgagatgaacatttcgttataataatgacagtagctgtcatttgctgagggctttctgcatgtcaggcagcctactaggtagtttacagatatttattgtctcacaacaaccttcagcatgggcaggattggtttcatttgacagatgacaaaactctggcttgacaactttaccagcatgagagtgctagactagggtcagcaaactacctcctctagaacaagcccggcttgctgcctatttacatgcagctcctgagtaagaatggcttttgtgtttttaaatggttgaaaaaaaaatcaaaagaagaataagagttgacaggtgaaaatgatatgaaattcaaatttttcacccataaataaagttttattgaaacacagccatgcttattcaccatatctgctttcatggcacaaaggcagatttgagaagttgagatgggtactgtatggtctataaggcccaaaatatttactacccatctctttacaggtaaagtttgccaacccttgtgctaggctgttgagttctttcagtggactttaagaaccacagtgaagagcagtgtggttctttcatgtctggccagcaccaggcctcatgcctcacactctgaatggtggggatatttactgagcatagagctaaatacggtacgtggaagaggagactgaagcttagagaggccaagtgactgcccaaagtctcatagtggggctggaattcagacccaaagtctgaactcctaacagttatgttgacctcagtgctggaaaacttgaactacatcaggaccactggaagggacggttgtactagagtttgctaggccttaccactgtttctgattcttccagtctggggtatgactcaagaatttgtatctctaacaagccaccaggtgatactagcactgcacatctgggaaccgcactttgattagacctaccatatgacatccagctcaatgaacagttgttgagttatggaaattgcagagcatggattcaaacccatgcattccccaaaagaaattgactagaaatttaaatcaatttagcaatttaagtgcagtgtactccagtcaactttcttggcattgtaataatttgatttctgccttcattgttttcattaaactcaagatttcttctgatgctatgaggctcaggccactatgcacactgaaaaacttttgcctttgcacgagctaggggctgggactaaaattaacccctcactggtggcaccacttgtgtctggaaaaatcagtttgtgattatttctaaaccaaggaattttgttcctgctgattgcatatcaaatcctttctcacactttggaccccccacttctttgctggctaacagggagaattaggggtgcaggaaacagctttcacagttagattatgctggctttggttacaaaagttaatgcattagtgctagagttcactatcttaattactgggttagtctcatatttaaaaagtcattatttaaggattaggaatggggaaatcgaagactggtgaaagacgatagttttttttcgtgttgatgattcatagccttgttttagacttttataagtaataaaaagcactggatactgctgatttagtctcttcctagaggctcatatttgtgtaaagaaggaaattactctgtaagttttcccttttgctttttcctggctctctctttctgtgcctttgtctatattgaagcctatttttctgatgttccttcttcatctccagccttcatgccccttcccaatacaggtgttgcagggatcgttagctagaatgtctaaggaaccatactatcaacccaagagaagggaagcttggtgaactcttaaaaccaagtagatgaaaccttcttgcagagtcccgggatataagccattccattaggaatccttccctgggaaatatgaatcattgctatgcctgatataaaatcactgacatggtgttcatgacagctcaccatgtcatccctcacacctttgccatggcctggaggctgactacactactacttgtgtttgttcttttattgctgaccttgtcaaccaggtcattctttctctcttcctatttctaagagaaaattcattccccagaaccagcaagtacctgaaccattgccactttatatgtgctgccttatttatttttcatctcattctttggctgggagtaaaagaacctttctctcctaccctggtttatgttgcctgattatctgttcgtcggctggtttgatgtttatttaattctgccatgctgcttaaccttagaagcctggttttgtggcttgatttgagccaagatttctgcatgtgacttctaacttgtgggtaaattaaggtttgtttttctctcacccatctttgacccatgatattaaaacgttatttgaagaaaggacatccaacccatataccactctaggtttctgtgttaaaactattgaaatccactatacattatttcagatttatgtaggttaaagggatctgggtttgaccttttccccacttatcttcagcaaatagagacatgtgaagaggaagtttatttatcaagcacttatagagaatctaagtactgtgggtaagaggaggggtagagagaatggagataaaagattcactgaacatctaattttttttctaggggaatttagggtgtgtatgaatagtaataataattgtaacaatagcttacatttactgagtgcttacctgtactgtgttggggctttatatttgtggattatctcattttatccccacaggctcatgaggtacatccacctaggtgaggaaatgaaggcttggagaggctaagtcacctctcaaaggtcatactactagtagaagaggggttatactttgaatccaggtgtttggctgaagtaaaatacatttcctagagtatattactcagatcatacatagataaacctatttgtaacttgcccatgataataataactttaatgatacaataacatcagcaaacattttctggacacttactatatgataggcactgtatttaattcatacacatgatttattttaaagtttaacaatcctattagaaatctattttatctgaggaaactgaggctcggagagaacttaagttctttgtctgaggtcatgtggccagtgagtggaacacctgtggggtcatattatttgtataattgttattgttattagctaacagttactatgtgcagtaaggactaggcattgttctcagcactttacatttattaattcacttaatcctcattttacaggtaaggaaactgaggcacatagtggttaaagttacaaaactattctgtggcagtggtaagatttgaacccaggcagtttgaccctggcatctataacagatgcgcctatgaccacagactttgtttcctttgccactttggtggtctgtctcctagagcagagaatcactagtactattacaaaccattccagtaacaaattaacctacttaaaaggagcttgcggaaatgaaaatataacttgaattttgacttgaaataaactgaactttaaaaatcctttgaggctttttaaaaaatgtatttgaagaatttccaatcagatcaacttaggaaggcccacttaggtcaaatcagacatggaggaattaattttcttgtggagctggtgttgagcctaagtccatcgtgctgcctgggtggggaatgccaggcagctttccttctttgctttccctgttctctcctcaatcactcatctctctagataaggccacagaacagccagagtgatcttttaaaaagtaaataagatcatggcagcctatttgtttgttgatctgtcagtcaaaaaactaaaaggatcacaaaaaaaactaaagggatcacaactgttttgcttatcgctgtgtatctatcatctagcacaatgcagtcaacaaaagaatgattaaatgaattaattttaggcaaaaaaattagcatgtgcaaagatccggtggcatgaaggaacaggacattttgggaaacagtgaaaagttgtgtatggctggcattgagctggctttgggagctggaagagataatacagttgggtcagatcataaggatcatgtagattctgtcaaggagtgtagatttgatcctctagaaatggggaaacactaaaggattttgttttttttgaggtggagtctcgctctgtcacccaggctggagtgcagtggcacaatcttggttcactgcaagctccacctcccgggttcacaccattctcctgcctcagcttcccaagtagctgggactacaggcacctgccactacgcccggctaattttattttattttatttatttatttatttattttttagaagagacggggtttcactgtgttagccaggatgatctcaatctcctgacctcgtgatctgcccgccttggcctcccaaaatgctgggattacaggcataagccaccgcacccggccacactgaaggatttttaaacagagtccttgggttggctctggccattgtattttgtatttggaaattatttgtctcaatgatgattttgctacaatgattgcacacgggtaatttcaaacagaactttaaaagttaaaatatgctaaagatataagtgtgcttgtttatgacagagcttggagttgtatgtatcaaaagggtcaagccaatgacaacataactaaacattttatacaaataagttattagttgtacaggttgttaaattttccatttgatgaagggaatcaagtttgagcattatctcttgggtcatttagacgatacattgtggatttatggctccttttggtagagtcaactcttgacattcggttgacagtattgcccttaaggaggatgctaggtggtccttccctcagagtcactatatagcagctgtctgtgagtcctgccttggaaagacaatattattctttcagcagctattatttattgagcacctacaatgtggcagatgaactaatcatcttaccttatgtgagtaaactttatagcatctctttgaggtagatgtgtccccattttataaatggagacactggctcagagaaggtaagagtaagttagagtgcacttacatacacctgggtgtgcactgagagtgtatttatatacacctagaagttaagaataacttatctgagccacggtttctccattgtaagtgctagtggggccagggaataaaattcagatctgtctgacccaaaataccttgcttttaaccatctggtcttctacctctgtagaggagagaatcatttaggaaggagcctatggaaataattttgatctgaattaaactgattatcttttaaaagttaaggagttcttagaacttttctttgatgttaagaacttttaaactagattatacttaagaagacaatttatttcacttgcttagttcaggtcagacctggtggaattagtctcactgataagcagatacttgaacagaatcttgatgaataagcatgagcattaacttcagactaactggccggatggctgtgcctcctggtctacccacctactgctctccctgccacaagttcctcttcttcatttgtcactcttttatctgttcttggcacagcaaccagaaggaattttaaaagatgcacgtaagatgatctcattccctttcttatctggtcagtggcttcctttttcatttggaatatattacgatctttgaatcatgactccacaggcctacaggatccctttccagtctcctccaaggcactcagcctcttattattttctagctactctagggtcttttcaggccctgaatctgaaacatgacatttgtggaaaatgatgggaagtactttatggctaaagcttagtctggactttgggggctggtgggacattaggtagactaagggtttggacttgaccttgtaggtaatggaacacttttgagacatttttagcacaaaactaaacgtaatggagccactgagctgaggagtagaatattcttctattgtctttttagagtgctcagagtccctgcattgccactggtcattgccctttgtacttggaaatgacttgttccaattatgacagccttgcaattgcgcaggccgaatgtttatcagaaaactgtaagttaaaacatggcaatgacatctctctccttgtgtgtcatatttaaggcacatgttctctgaaatcaagaagctgggctaggatcttgcactggccccagaccatattctgttgtgaccatgcttcagtgagaatgtgtcacgtgtaaaatgaagataagcaagaatatcagtctgtttgaaagtgctaataaaagtaaaatattcttggcaaataaagctattaatgtaggtgttgaaattttcatttagtcagagcagtcctaaatttaaatgtaaccttttgagcccttagatcattgagttaagactctttctcatgcggatgaacagtaaatgcttgttatctgaagatgtaaattgggaggagtaagggacttctgccccattgtgcattaatgcctactgtttgtttccctgacttagaatgtggctccatatttttgccctcaaggcagctattgatggagtcatcctatgctccaaaccttgagctaagcaccacatatagtcatgtgccacatgacgacgtttcagtccagtcaatggcagactgcctatatgacagtggtcccataagatgataatatcacatttttactgtatcttttctgtgtttagatatgtttagatacacagatacttaccattgtgttacagttattatacctatagtatatagcacagtaatgtgctgtatgggtttgtagcctaagagcaattggctataccatgtagcctaggtatgtagtaggctacaccatctaggtgtatgtaagtgcactctatgatgctcacacaactacacttacggatgtggttctcagaacatatccctatcattgagccattcatgactgtatgtatatgtcagttaaagcttataacaacactgtgaatctgttttttcatcctgctgtgagtttggattgtttatgaggaaatgcgggcttagagaatttaattgcttaaagtcagagagttaggagatccttcagttttgactgatgtcaacctccgtgctcttaaccccagctctgtccaagtcataagaccatcctatagacaggccagaatggtacaagtggaaacacaggaagagatcttctttcctatagaccttaaataaaaatgtctcttggatcatcttgtctgaaagcccatctttttgggtttatttctctgattagagagatactttgttttgcctaatacgtatttttagaaagtagtacaggcatcagtcttttgtaaactctttgagatttaaataaggaagtttgctgtttgaaggactttgtggctaatcccttggtaaagaagtatcttataattgactatgaatgccttagtagctattctgtttcataacttgactttcaaaaaataataatggcaaaagatgacattttttgataagcaccaggtgcttttagaagcaatttttatgggagtttctaatctaatcatcacagcaacccttcaaaatgggtgctattattgtgtccatttgacagagaagtaaactgaggtgacagtggctagatgcagggatggcttcgtggcatgtgacctgcatgatcacacaggaccccatgcttagaagggccccatgcttggtgtaatattctgcaattattgtcgtagaagacttcataattttgaacaagggccctgcatttttattttgcatggggcctcataaattatgtggttggtcctgcctagccaaattgtccaaggccattccatggtgagcagcagagttgaggttcaaacccagactgcctggcgtccagcgtgactgcctggcctccagagtgattgcctggcctccagggtgtgctcttccattgtgtcctcctgcttcccatattcccatgttcttaagcactgtcctccatcttgtttttctctggacgtgtctttagaggcagaggcaggtggtttgactcatgtctgttgaattctaaagattcagaatttatttgttgaactgaatgtttgttacatacaatttcctaattaagtttgtgggagtgcagtagtaaagatttgaagatatgggaagaattgcatatcctggctatagtgaaaaatcatagtctaaaaataaatgggaataaagtggaaacactgtaacatgtttgctttgtacagctttaatggaaaaaggaaaggaaagaatacatatgaaaagaaggcagtcccttggcactgcctgtctcaatgctgtgtgctgtggactggggacacttaattaccacgtacaattttatggactgttcatgagaagcttctttttaacttttcatggattgcagtaaaggaaaatatagaaagatagaagaggattttcatcacgttggcaagaactgttcctccatgatctatggctagagcctgaaactgcccaagttccatctctcagcattttctgagaactttctgtgaagagaagttcagaggccagtaaaacaagtgtggtcacgaaaggaatcagaacatgactcccccaaatctgcctctttgacataaaattatttttgagctgaaggaaattaagaagcagtaaacaggggaaaagctctctctatcctccccattttctgcctgaagacaggatataaatcctcctctactggagacaactctagactcatcagctgagagacaacgccagaggaatctgcaaactaacctcacttcatcagttttctcctgtatatttaccttcccacagtttcccatccttggaagcccaaaacctcacttctttgtcctgtcttttcttgacaactttattgttctttgttgaacatgccacataagccagatgccacataagccagagttctaagctgctgctgtgggttacctttcattgaggtttctcctgtgtgatgtacactgcatgcattcataagttgtttgttttacttctgttaatctgtcttttattacgggagttcatcccaactaagaacttatgaggcttgggggaaaagttatttttcctccctgacagtcactgcagggcaactgacgttctgacagagggaggcatctgccacaggaacacgaggaaagcagctgatagagtcaggaggagtctagaggggtcaggggaattgtccatgtagagaagagggacagagtgttcatctatggagggaacagtaaggacaaaatcacggaggcgagggagatcacggtcaagatgaactgcagtatttggccctgggggaagtgttagaaaggtaggtggggaccaaatgctattgtgctaagttaaggagtgtggatttatatatcccaaggcattagggatggtgatcataatagctagcatttattgagagcttcccaagtgctaggcatgatttagtcccataatatccttattctccaacactcctttggggttagttactaatctcattttacaaagaagaaaactgagggacagagacttttaataacttacctaaggtcacacaactagtatgtttcagagccgggattgtgaactgggaagtctggctccagaacctgtgttcttgatggcaattttatactgattccagtgatggaagaattttaagtagaggaaacgtgtatatgatttacatttccaaagattgttctaatggaagtgtggcctgctaggtgcaaggagatgagcatctctggttttgccaccacagaaactatgaagacatgttctttaaaaatgacttctcctctcttcccttggtatatgggtgcaatcaattcttgctttaaataccttctccctgctctttctatctctgaacagattcctcacccccaccccccaccgttccttactcactgagctttatgctacttgaccatcactcaacatcactcaccaacctagccttctttcttcttcctcttggtactgctctctagattataaacatccatgtgatttctggtcacctgtatgtatacctattaggtgatacgatatgtacactcagtggtcattattaatacatgaaatggctgaggactctagaggcatgaatggagttagagtcctttctgtgatatatatacccctgggatctggggggcaggcagcaaacctctttggaccttagagacaaactgggcatagtaatcatatctgctgtactggttgttgtcagaaacaaaatgaaataagatgatatactttgtataaataatgtttatacaaagtataacattatactttgttatatggctacattgtctctagtgtaagcaattttatttacaatttgtactctacttgttttgatatcatttatggcaactttatgtattatagcatttcaaacctggagggatctaggcagactgtggttgattagttgatgtttagaaagactggttaattcactgccagaatgcagatggggtggttggggaggataactgttttctccaggcagtgggtcagactgttcccaaagtgtgatcttacccatatcacttaacctctctgggcatctgttacctcctggaaaatgaaggcaaagctgcctacttgtagggctgatcatgaagaagattgagatgttttctgtaaagtgcttggcacttagcaagtgttctataaatactattattattttcattcctgaaaaggaaggagttagtattctagtgttgagtgtcaaaagactgggggaaggagtgtgggaggggtttatacactttccttcccatcctctcagttgtcctccctcatctccactccctccatctccaatcttttctcccctcagggctgaatgaaattgaatgtcttgtaaacgtgtgcagcctttgccaccgggccctcggacatgcccttttaacattctgacataatggatgaaaacatgaacagctgacagtcattggttaaatctccaaacttttcattccctcacctgtggggatggtgccctctgcctggtgaacccagcccaggcagagattgcaggagctggctctgctggtggtgggcctggttacctaggcaacgtttacctgtgctgatgacaaagggcctgtcactgcctcctgatgcatgcagaagaatattaagtttgcggggagatggaaagaaacaattttctcttgaaatgaggtagatgcaggtgttaatttctttggagtgaattttctgttttcagagaggcaagggtagagcttaaacacaaacttctggctgaaaatatttagtttgcgaacctggcaagcctcttaagaaaaaaaacaatcctggtgccgggactgttaggcttcctgtcttttcagcagcttattgcatttgttttactgctttgaaggattggaagtctctgaaggccatttctttaatgacttggaatattaatgtaaaaacttgcttgttggacaatacagtgaatactatagctttgcctctaattggcttttcagtccttcacgctgtaaagcccccttcttttaagacattttctttattttgaaatatattttatatttataaattttatttataaaatatctttattttataaataaattaataatgaaggaaagtgcaccaaacaattaaatagcccaatgatttatcatgaagtgaatatattgatgattgctgccgttaacaaggtgaggacagaacatcgtaggtgtcccagaaacagtccttctccccactttcaacccttcccgtctttcactctcccaaaggagattgctgtcttggctttccaaagcaaataaacgaagttcttactagaggttttgttccctaagtgttcatttctaaacactctagtttagttttgtttcttttgaatttcatgtagaggaagtcatagagcttttttttttttttttttgagacagagtctcgcttttttacccaggctggagcacagtggcgtgatctcggctcactgcaatctccgcctcgcgggttcaagcgattctcctgcctcagcctcccaagtagctaggactacaggcatgtgccaccacgcccggctaatttttgtatttttagtggagacacggtttcgccatgttggccaggctggtcttgaactactgacctcaggtgacccacccaccttggcctcccaaagtgctgggattacaggcgtgaaccactgcgcccagccagagcattgttttatgtatggcttctgatatggtttggctgtgtcctcactcaaatcttatcttgaattgaagttcctataatccccatgtgtcataggagggacctggtgggaggtgattaaatcatgggggtggttacctccatgctgttctcgtgatagtgagtgagttctcatgagatcttatgattttataaggggctttccccctactttgctctgcacttctcttcgctgctgccatgtgaagaaggacatgcttgctcccccttctgccatgattgtaaatttcctgaggcttccccagccatactgaactgtaagacaattaagcgtctttccttaataaattacccagtcttgggtatgtctttattagtgcatgagaacagactaatacagcttctttttttcagtgttatgtttatgaagttcatccatgttgtggtgtatagctgtagttcattcatcttacttgctatatttcattataggaatattccactatttatctatccatttggccattgatgcatatttgagatatttccagtttttagctataaatactgatgttgtgaacattcctgtacctgtctcttggggcacatgtgcatgcatttctgttggttgtgttcctagaagtggtattgttggggcataagatatatgttatctttggccttagtagtataaaaaggttttgttatttttttttttaacaaaaagcaaaataattgctctcatacaaatacacaatgaacgtgtgtgaaagatgttatttaactcattaattaatgagggaaccagtacatgttagcagctggttcaaaggagaatggaaaggtccatgtatatgtaggcaataagagatgaggaaatgaatttattaataaaagtgaaatgggtctatccacaaggcaataatttgttgcatttccaccatacatattcacttgcgtttctatggacgggaagaatttgtatcattatcagttttctgcaacttaaatagttgtagaatagcagaaagacatagaaaggcatagtaacacagtagggtgcattagactgcacgatcacaatgcttttttttcttccctattctaaatctttcacaatttttcctgatggtagatattaccaacctgttttccaaaattagtgtatcaaattactcttccaccagaagtatcacagaagttccttttgcttctggacaacaattggtttaaacttttgccattctgttaggtaggcagtggtatctctttgtggttttaatttgcatttccttgattaagaatgaggttgaacaccttttagatatttattggctatttgaatatcttcttgtgtgaactgcctgtattagtcttttccccatttaaaaaaatgggttctcttttaccttttaggggggtaggagtgttttatatatattttatgcattaatatatattttccaatcatatgtgttgcaaatatcttcttccacattttagcttgtcttttcattcctttactggtgtcttttatgaacaaaacaattatactacagcctattttcttaattttttattttacaattaataattgttaaaatccctccttaagaagtctttcactagtttgatttcttgaaaatattttagcatattaatgtctagaaactacattattttgcctttcaaatttagatttaaaatctatttcgattttatttttctgtatgatgtaaaatagggcatcattttttaccccaatatggtatccaattttcctggcatctttcattgaaaagactgtgctttcgctactgcttggcagagacaccgaaatgttcatatgtttgagtctttttctggatatgttgctaaattctagtgatccattgatctatttgttcattttaataccaatgtcacactgtagttttttatgataagttttatgataagtctttatttctgatagagccaaacctcccaccttgctgtttctctttaaggtgatcctggccctttatacttcctttgagttttagaattagctcataaaattccacaaaaattgtggatcttatttactgagtttttatttaagactgcattgaatccttaaaaattccacttctaggtatttatccaagtgaaatgaaaacgtatgtccacaaaagagtggtacatgcatatattcatagcccctttattcgtaattgctccaaactggaaacaaccagtatgtttataaaatgtaaaactactaagcaatgagaaggaatgcactgtcgatacatgcaacaatgtagatgaatctccaaaacattacattaagcaaaagaagccagacatgaaagagtacgtaatacgtgattctatctatatgacgtttataaaagccccaactctacagtgatataaatcaatcagtggttgactgaagtcagggatgaagtgggcagattagtgggaagagctttacaggggcatgtgggtatcaactggggtgatgattacagagatcactaaaccacatcctaaaaatgtatatattttattgtaaataaataatactttattaagttttcttttaaagactccattaactccatagattcgtttaggaaggactaacatttttacaaattgagtcttccaacctaggaatatgttatatagctccaagtactattgcatttcaattctcacattaatattcttttgcttttatgtagaaatttttcatatttttcaaagaaatatccacttattttgaggtattgttaagtatttatgatacaatggaaattaaaaaattaaatttaattttgtttatagctggtttataaacatgtagttagtttttatttactgaaaattatatccagcaatcttgctatattgacttattaattttatctgtagattctttggatttctacatccacaatcatatcatttgctaaaaatggcacttttgcttcttcttttctagttgtgttatcttttatatctttttttacctgattgtactgactccaaaaattaatacgatgttgatatcaaagagaaagttgtcaatattttatcactgtgttaggtttgcagtagtgtttttatagatatattttaaaggaatttcccttctattcctcctttgctaagaagttttattcattaatggatgttgaattttatcaaagctaatcttgcatctattaaaattattatatgtattttctgcttaattctgctaatgtaatgaatatttgtaaaatgttgaacaaccacgcatttctggaagcaacccaattgggtcaagatggattaacatttttatatgatgttatatttagtttgctaataatttgtttaagctttttgcctctatgttcattaatgaattagacctgaaattttcctttctcataaagtccatgtcaggttttggttatcgaggttatgcttaaagtgagttaggaaatgtattctcttattgtttggaggtatttgagtatgatcagtattgttttttctttaaagttctggtagaattatctggggaagtcatcagaatctgtttttttttttttcctttgtgggaagttttaaaattatgcattaaaattttttaatggacatttttttaatgccagttttagattcacaacaaaattgagcagaaggtacagagataacccatataacccttgccccatccgtgcacagccttccctgtgaccaagatcccccatcagggtgctatatttgttacaattgatgatcctaaattgacacatcattatcacccaaagtccatagtttatactaggattcactcttggtgttgtacatcctatgagttttggacaaatatatccaccattgtgtcacgcagaatagtggtactgccctaaaaacactctgtgcctgcctatccatccctcccttctaccgtaacccctggaaaccactgacctttctttctgtctctatagttttgccttttccggaaggtcatatagttggaatcatagagtatgtagccttttcacattggcttctttcacttactaatatgcatttaagtttcctccatgtcttttcacagcttgatagctcatttgtttttagcactgaacaatatttcattttctaggtgtaccagaatttgcttatccattctcctactgaaggccagcttggttgctccaagttttggcacttataagtacagtttctgtattcgtaaacacagaataaacacctatatgaagatttgtgtggtaagagtgttttcaacacttcctcatgttgatcttttatattgtatgcttgttttcacttcagtcacgtctgctctttatccatttcctttcttctactttcttttgtttaaattgactgattttaaaaaatgatttcttgaagtggttagtagattctcaaattttgtcgtaatgtatttacacaatagggttccccttaagtactgtttttgctgttttagatgaaatcattttattatcattcagttaagagcagtttctaatttctaccagggattttctagccatcttttcattattgatttttggcttcattgcattgtgaggaaagaacacgctttgaatgatttcagtgcttgaaatgtgttgagatgtgtttgatttcataacatctggcatatttttatacgtgtttgctatgtgcttgaaaataaagtatatcctctatttgttgagtgcaatgttctatatgtttatttggccaattttgctgtttatgttcttcagattttctgcattctcactgatttcttttgtctttttttgttttatatgtttctgagagagatatgttaaaattccataatatgactgtagacttgtctttttctcaattacaaaggatcttccatatacctagtaagactttctgccttacagtctatcttatctgatattaataaaaccacaccagctttctttcagttagtatttgcctggtgtgtttgtgtgtgtgtgtgtgtgtgtgtgtgtgtgtgcctatttgaatacttttagctcctgcatttctatagcattatttttagatgtgtctcttgtatacagcatatggttgagttggacagaatttgtcttttaattgcagcattgagttttcctacttttaatgtaataatacacgggtgggttgaaatttattattttattaatttgctatctttcttttagtcctgcttgttccttgttccagtttctcctctttttctcccttctgttgaattgaggatttgttgttgttgcttttaaccattccactttttatttgtctattaccttggaagttgtatattcttttattattattttggtgcttacactagagattatagtatgcatcttgactcaggtcttagaccactttaatggcatttatcactctcttgacttctgtgtcattgttatgtattttacttctatacctttcagatgcccaagacattattattattattgctttattcagtcataattcattttgattaatcatatatttattcttttctttgttcttcattttattttcttgtattatttatctttcatctgggagcactctctttttgcctgaagaacatcattcactatttcctttattgtaggtctgttggtaacaaattcttttgttttttgtttgaagtgctttattttactatcactcttagggatatttcctctgggcataaaattctaggctatctgttatgttctttcaatacttaaaagatattttatttacttctggctttctttatttctgttgataagttagataaaaatccaatttttgtttctttttcacccttatgctgatttttagtttttttttttttttctttgtggttttagcagttttattgtaattggcctgggtgaagttttctttttacatttcctgcttggggtttctaggattctttgtcttggctccttctgaggcctgatatctttcttcagttttggaaagttctcaggcatcattcatcttgtcaaatattgcttttccccattcagtctcttcttttccatttccatgggctatagttacatatgtgttatacctcctcactgtatcctgtagtgtcttatcctgtattttccatccttttgtctttctatactttattctagttattttcttctggcttctaattcctgcttctgctgtgtctgttcttcctttattaagttattaattttagttaatgtatttttaggcctaaaattttcattcgactctctctgtttctgagtttctcatttttatgagttccataggatggcgtagcaaattactagagactgggtagcctagacaacagaaatgtattctctcactgttcaggaggctggaggtcaaggtatcagcagccacactccctccaaaggctctagggaagaatccaccccttgcctcttttagtttctagtggctgttggccttcctttgcttgtagctatctctctgtccctccatttcacatggccttctcctctctgtgtctgtcttaaaatttcttctgccaatctcttataagaatacatgtgattgcattcagggttcatcttgataatttaaggtaagtcctcctctcagcacccttaattcagtcacatctttttccatataatgtattatttgctcctttgctacataaggtaatattcacaagtctcagagattaaaatgtggacatatcttttttggggccaccttttagcctgctataccattgtacgttgaaattctcaactttataattttctctttctataaataggaagactttttacaaaaagtctgtttcagataattctagtatctggaggcttgtgggtgggtttctatttctgttatttctgctggttttgtttatgtcttcttatctccttatgtgcttggttatttttaattgtgtgtgagacagtatattcgtacaattttttacagatataatttgaggtcaagattgaggtttctcaaccccagaagggatttacatttgcttctgcaagcacttggggcattagaattctggaagcatctgattttagtttcagatattgagatggcttgaagatgatccatagacctctgcaagggcctcttagttctctattctcccttcctgctaggacacagctctttgaggagcccagtccaaaacaaatgatacacctggtcagttcccccatccttagcaggacttaaacacaaatctttatttccttggctcctcaatatgtcgttaggggagaaataggcccagaatgccagcttcttttgtccagacttcttccttcccttgatcctggcctgacgcttttttttttttttttagatttgaggtgttttaaagcatttaataaatgctttttctctcttttacttatcttcaatgggaaggtgtattagtctgttttcacactactgataaagacatacctgagactgggcaatttacaaaagaaaaaggtttattggacttacagttccacagggctggggaggccttacaatcgtggtggaaggtgaaaggcatgcctcacctgcggcagacaagagaagagagcttgggcaggcaaagtcccctttttaaaaccatcagatcttgtgagacttattcactatcatgaaaacaacacgggaaagacctacctccatgattcagttacctcccactgggtccctcccacaacacgtgggaattcaagatgagatttggtggggaaacagccaaatcatatcaaaagttttatctggcatatctagtgagtcattatcagaagcagtagtctctctgaagcttttctcatctatccaccttacatttttatgattaaaaattccaaaaattacagaagtggagggaatagtccaaatattcccccatcactcaaatgcaactcttatcaagattttgtcacaatttgcatggaaatattcacaacctataagaagagaaagttttaaagcaaggcaatatctcaactcacagccatccacttacctctaatggccagcatcagagacaaagacttctgccttggttactgctgtcctgagcttctagcacaggtgtgcccctagatgatttcagtgagctattgttaaatgaatgtgaattcactgaagaaccacagactgtgggagctggaggaagtcttggcttgtcgtaatgaaccacagattacagatggagatgctgacatcctgagattaggtcacagaggtgcatgggagagttaggccaaggtctcaactcagggctctctccacttttccacacttcctcctcattttgctagctcatttaattaccactttttcttcctttctgataacactgaagtttaagagcatttcattacaagtgtgatgatacaatgtggtattaagacatgacaaggcaagttttattggccattactatttgcctcaagtgagtggcaaagcctttgaccactcgaggcatatattaatagccctataaaatacatcctggattgctagtgctattaccgtctggctattacatttaaaaaaatattgtacaaataccacttcaaataattttcttactcttttttttaaactggaacgattagctttttttatgagagacaattcttcacatgatggagaaaatagaattgtcaggtaacatggaaagagtataagctttggagtcgtaccaaactgtgtgcaggtatttgctctgctatttatcatcactgtgacattaggcacttttcttaaactctctgggtctattttcttctctgtcaaatgacaacaagaatgcttgtcttttagaattcatatgtatatgaaaacacctggcatagggccttgaacataatgagtggtcaataaatcttatatttttgttgttgttattattgtcatgataatgaaatccaatgggaaattttttcttttaattagttgatttatttgtaagactaaaaatgttgttgttataacagatccttgtcttgcagggcagtctttctttgtttcctctctagccctcatcccttggaaaaatgagctgaaccatgttggttggtgcaagaggggctgacagaagagagttttgataaatccacaagataactttggaaactctttgccattttccctcctactcaatgctgctgggactttgagctcgctgaggcagtctaaggctgtgctttgacttcagtgctgtgccttgtgcttgggataattgtgttttccatttgatggcccccaatgctttgtgtaggaattggatggtgcacccatgctcctcaaatgctgaagcagtcatgtcacttggtggggtgaggtggatcatcagcaacaacatacttttcttttctttttgaattaagcacacggaaaaatccataatctaaacatgagggacattaagttttggatggaagagagtgaattttgcaacaataacaactaaaaacccaggacacagaacaattattgaaaacaacttgctgaagtatataaataaataaaagtgtcatttctgaagtatctttccttccctaggctcactgccattgtcatgggaaaagtgtgcatggcagcatttactctgaggtaataacatggatacatttcccgttgctcaagacttgtacatagagtctgaagacaaattcttcctatcttgctgagaaattaacttctatttttccattcctgtgagccagaagggtaattaccacatgctgttcagtcatgagtttatggaaagaaacacaggcttcattcagggtcttcaccaactgggtggggttgggttggtcatggagagaacttacattgtgggtttacagctgtactgcaaacatttcttcaagtctggagcaaactcagcccctctttcctgactaacttcttccctgcctaatccaatgaagacaatggttgatgagaataatagcagttattgcatattaagtattaatcagacatgttattctttaaacacacttttgctttttttttttttttttataataatcaggcatccaatgagatctgtcctctttttatcctcatttcactgagaaggaatggtggctctgaagagttaaataacttgcctaagctcacaattttagaaggtatggccaagactcaaacccagattggtctgattgtcaaagttgtgttctattcttaaccaattttctactttctttggtaccatgattatctccttgccttataaatattcttgtatgtggtattatctttgtcttattattcatagtacacaggggctttttttcttcctacttgcatttccagttccttccttattaatcagtgtgagctttttgcgattgagccctcttttctcttgccccacccgccagcccacctcctgttcaaatacagccctgcgggtgaacactatgggcgacccatgtgtgtgggctcataggaagatgcaatgtggagaagaatggaagcttctatggcagatctacattcttttttctgtcctctccctctctctacacccaatgtactttattttttggcccatttttgctcctatatgccctttcatcatcctcagaacctgtacccttggcattttgtcggtagacatttatatttcctggcattgaggctatagatctctaatacttgaattgattttcaaaattagggaaaagagctgcgattttagctatatatttgggctgtttgagttgaaaatgatgaagagtaaagtaatgtttgctgtaagaggtgggaggcaggactgtgacacggtcagctgactcttagatgtgtaataatggtctggcaccaccagtctctcactgtcttcttgaaatcacctctaaagaagagtttgatctggaaggtcaagcctagcagtgaactgaagctgttctctctgagtgcatttattcatttattcacaaagcagttactggtctatgtgcctcaagattcctaaatctcattgagccaccaacccttttattgaaagctacaggctctttttttcacaaaaattcacagaatacataacatggttttgcatgcaatttgaagggattcacagatcctttgaagcccatctgaggactgccagccaggacccctagcttggtgcactacctttcttgtttaatcacattctaatctccaaatcaaggcctcttccattgtgaatagagatagaaactcagctcagattctttgatggaactgtgttcagccaagttgtgtttgctcatcactgaagctttaagagatggttaaagaaacaaggtaactgtgtggaattacttatgatcacaaaggcatctgtagcaaaggatcagtctttacaggagttgtcttctgagcctgggtatgaagggtctctaaactattttatgggaaatttaaatccctcgatcgaaacaaattatcataggagggaagaaaaagtaaatctcattaatggttaggtgtagtgggttaagtatttgcaaaagtcttggtcattttgaaaatggtaataccagtgcaatgagttctgaaatctgtagacatagtgtgtgtgtgtgtgtgtgtgtgtgtgtgtgtgtgtgtttctgaagaaaataaaaattttcacatctaaaataaaggctcagtttcctttggggtgccttagttcacagcagtatgacagctaaccagaaagctgccatactgtgattctgtttttatattatttaattagatgatttaaagattctctaaaaattctggtgcagcctttgtgttcctgggaggaatcttacataacttggagtcctagaatagaggaagagaacagtggtacccaggcctcgtttgctgttatggtttatgtcgcagacttgctaggtatgacttccaacaacacaaacagaaggtgacaggttacaaaagagtagataaaattttttgctgacttttctcctggctacactctccctacttcctccccattaagagtaatgggagagttcctgaactaaagttgcattgtgtttccatgcagaaaaccaaagactccccgtaagctgagctgaggtaggcagggcatgaaaccgaagggctgcaggtttgtcatttgttgttaagagctgtggcatatttggccaaaggggctcattgtctacagccttctgtaagttattctgcaatattccattcaaaggaaaagcagccaagttctgtttccacctttctaaaggctttggtggttcctgtccattgggtgtgtgtcctgccctttgcctcactgtctcaataaagcatgtgaagaccagcttcctctccggtctggcggatctgttctcaggctgagcagagagtggcaaaggctgcatctgcgttgcttgctcctggcattgcctgcctgccagggcaccacacaagagctcgggcttacaggcacactttgggtgaagtcattcttccctgaaaactgagatgggaaatttatcctgacatgtcagaactgatgaagaaggctaagcaatggctacctgagcattagtcttgggagtgtgttctttcaagcacaggtttaggtttgcccttctattgtttcttctactaacacattatgaaggtagatttccactggaaaaaaaagaccagaatttgaaaatgtaatagagtgcatattcattattaagattataagaaagcctttgagaggatcaggcagtgagctgagaattatcactgaagtttaatttgtttattggatatctggatggaaaccagcaggactggccatgccctgttcctctttcacagccctgcttctgcccaaagggctcattcaaattctttttcattctttcagccctccacatatgcggagaactctcatattttccacattcctttcttctttggaatcctgctctaaggaaagaaataggtcttggtcacctataccttttacaccttactgtgaatgtcaggatagtgtataacctggatattgatactcctggggcatttgagtgttatcgtttactgtgagttagaagactttgacttctttaaaaaggaagtagaagccatgcttaaatgctttcaaaaacaaacctgcacagtttgtgctttgccctatttttgaatcatttgtattaatgctgtgacattgtgagcacagtgtgtgtgagtcttgggagaagtgaggacctgcaaagttctggcttgccactaacctgcactgtggctttgggagtgtcagctccctgcatcactataaaatgagtaggttgtattaggtgatcaccagaggccctgctagacctgacagtccaaggataaagttgagtgctaaaggagcaggctgtgtagacagattgcaagtgtccaccagtggatggtcttggcacaacaaggctgcctcctcatggtctttggtcccaacaagttcaatataaaatggaggaaatgttataattttaagcactgataccagggtttccttagggggagaattgcctttgtgtgggaaaataccgtgataagacatttggagtagattgtgaaacactgaagacattagtgtctgggaacctaagccaaaaaagagatgattaatcttttgtacacaagaaagtaaaaggaatttgtgctttgttcagccttatgcagaggtagaaaagaaaatagaggagaagagacaagagaggaaagagagagaaaatctggaaagatggcagaagactggatgctgtgtgtcctaaaagccttagtaagaaaggcttagagatattaggaactgtaatgtctaatgtgagatattaatttagtttactgtgtgttttgctctctagtttctgtgacttaccaatctctaataactcaaaaatggtttttgagtgaattattttgtgaagactagggaaggcaatgaggatttttttttgcctagattaattggaaacagcttgtatggaaataaaatattacaggcagaggtgactagaaaacatagccccacccagaaaactgtagacgtcttagtgagaggtttgcatctccactggacatgcagtttggaggtctctagccaatgtcgtctagatcttccagggctggtcaggtgggaggttcccaaatgacatttttttttttcataataaaataattttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatctgatttctcaatcttttccccacctttcccccctttctattccacaaaaccgccgttgtcatcatggccccttctcaatgagctgttgagtacacctcccagacggggtggtggccgggcagaggggctcctcacttcccagtaggggcggccgggcagaggcgcccctcacctcccggatggggaggctggccgggctgggggctgacccccccacctccctcccggacggggcggctggccgggcggggggctgacactcccacctccctcccggacagggcggctggccgggcagaggggctcctctcttcccagtaggggcggccgggcagaggcgcccctcacctcccggacggggcggctggccgggcggggggctgacccccccacctccttcctggacagggcggctggccgggcagaggggctcctcacttcccagtaggggcggccgggcagaggcgcccctcacctcccggacggggcggctggccgggcggggggctgacccccccacctccttcccggactgggcggctggccgggcggggggctaaccccccgacctcccttccggacggggcggctggccgggcggggggctaacctccccacctcccttccagatggggcggctggccgggcggggtattgacccccacctccctcccggacggggtggctgccgggcggagacgctcctcacttcccagacggtgtggctgccgcgcggaggggctcctcacttctcagacggggcggttgctgggcggaggggctcctcacttctcagatggggcggttgccaggcagagggtctcctcacttctcagacggggcggccgggcagagacgctcctcacatcccagacggggcggcagggcagaggcgctccccacatctcagacgatgggcggccgggcagagatgctcctcacttcctagatgggttggtggcggggcagagacgctcctcactttccagactgggcagccaggcagagaggctcctcacatcccagacgatgggcggccaggcagagatgctcctcacttcccagacggggtggcggccgggcagaggctgcaatctcggcactttggggggccaaggcaggcagctgggaggtagaggttgtagcgagccgagatcacgccactgcactccagcctgggcaccattgagcactgagtgaacacaactccgtctgccatcccggcacctcgggaggccgaggctggcggatcactcgcggttaggagctggagaccagcccggccaacacagcgaaaccccgtctccaccaaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttccgctcggcatcagagggagaccgtggggagacgggagagggagggggagggggagggggagggggaggccaaatggcattgttatggggtcttatctgcaaacgcagaactccattatgttttaatgatggatgagccatttttacaaatttgcaagattctagaagaaagaacaatctggaatgtgttcttacatacttttttttggtttattttgtttttctgtttttttttttccaagatggacactcagtgtgaatgttcttatgtactgttgattgtacctctaagatgatgtaatgacctcatctcatctagctgtcaacaatggcccccttttggccagaggttatttgactgcttcagagagatctggaaaacacaatttcttagttttatctgtggccaattgtacctctgtaatggctgttttgtccaccattgttttctgggatttctgaggaaaattctgagacaagtaactcctttgtttgtggaagttagttttggaaattacaaatgaagtatctttttttttttgagatggagtttcgctcttgtcacccagctggagtgcaatggcatgatcttggctcactgcaaccccacctcccgggttcaagcaattctcctgcctcaacctcctgagtagctgggattacaggcgcctgccaccacgcccggctaattttttttttttttttttttttggtatttttagtagagacggagtctcgccatgttggccaggctggtcttgaactgctgacttcaggtgatccacccgcctcggcctcccaacgtgctgggattacagacatgagtcactgtgctcagccagacaaatgaaatttctatcctaaaacagcatgcattacctaatcccaggtggttaaaaaaatgtatatatatttaatggttgctctgaaaaaatatagacagcatgggttccaaaatattaactatagtaaggagtcccatcatggttttcatagcatcctatcctgtacttgtacttgtatgttgttgcatttataaagattgaaattcattactaatgtagttggttatcagtttctttcctagaacagggagcacctgtcctgaaccaggtccagggtagtgtacatgacacctcagcaatagagtgattttctctagttttacagtttctacagtgaacatattatttttcctaattacaaaatataaatctctttaaaatgacgcatgcataattaggtactcagtattacttttaggaaattatatttgtgcaactgaagaaaagacctacatgggaagaactagaatggaaaggaacaggttgagggatgtatataaatggtaggtttctcactttgggaggccaaggtgagcgaatcatttgaggtcaggagttcgagaccagcctggccaacgtggtgaaaccccatctgtactaaaaatacagaaattagccaggcatggtggcttatgccagcacatgcctgtgatcacagctacttgggaggctgaggcgggagaatcgcttgaaccggggaggcagaggttgcagtgagctgagattgcaccaccaaactccagcctgggcaaagagtgagaccttgtctcaaaaaaaaaaaaaaaaagaaaaagaaaaaaaaggtaggtttctgctcttggatctaagtgctcgattgtagagaagatatcataaagagagtccaaagtgtgagttcatacccacaatagccagtaattgacatggcagctttgttttgccttcacttaaaatactggcatggtgtgtattttgttgtctgtccttcagaattggattttgttttttcaaggagaaaaatagatgagactgctactataggatcccttgttagatatattacatttcaggatatatttccaggcacttcgtggtggaaatctggctctcggagcttaggcttggttttgggatattttctgcatgtcagtatatttcagtatgcctctaagtaaaccaagtagctcctcctccccctcaacacctggtatgattcatgactgatttgggtagctgtaatttttctaatgtcagttagaagggaaagaatttaaatttactacatgccaatcatattccaaagccatacttagtattaaaaccacagaaggagtcatttacatttaacaggagctgtgggtcttaagcaatgatcatttggtaatgtatgttttgattttaggttaaaaagaaccttgatattgtgggatttctggttttcagatgagtggctagtagcctgtttttagaaagacattggggatgggaacatgtatttggcttctttgagtacagaaattctgcttcttggtggaccacagtttgactttgttttcggggttaccttggtgtaacaaagcatcccttatgccttcagggctgtccttaccacccatcacctgccaattggttcctgtctatgtcagtgttttgaatcagaatatgaggtgtgaaaaatacttcattcgattttagaccactcctaccttttgggtagtattacatttgaaagtttaggatttggccttgttcacttgtttatatttttactctaaaataggtgttaaatatattttgagcatttactgttgcagggcactgtactaggtactatggaattacatacaaactggagagataggctctgctctcattaagcttgttgtatgataggaaagaaggaaaacaacaatgaaaaagctacatagccctttcattgcagagtggtcagtgctatggtgtggacagagtgtcctgagggagtctaagtggaagataagttgagggagaagtggatagagagtgtgtgtgaccttatgcaaaggcactggagtaaaaaggtgcatctgtcattgaagagaatgaaaaaaaaagttcagggacaggagctcagtgagggaaggtgagtatgcccagaccatgaagtctcctgggctacagtgaggactttggactctatgagctaggagtgttctgcccacttaaaaaaagacatgtaggggacacacattattttatttgcctgaagcttgaccacctctcctttagctcccttccgcattctggaaaatgcttctccatttctgtagctccatggttaccatggaggcagccacgttgttttaagctactctgtgtcccaaccacagatgattgatccagggattttatttgattccttgggggtgttggaattggattataaagtgaagagctgttggagaccaagttctgtcaagcagcctaaagagcagagatggaagaatgaagcaagaccacagagagtatttaaagtaaaatctggctgggtgcggtggctcacacctgtaatcccagaactttgggaggccaaggtgggaggattacatgagaccaggaattccagaccagccttgccaacatggcaaaaccccgtctatactaaaaaatacaaaaattagccgggcctggtggcatgtgcctgtaatcccagctactcaggaggctgaggcagaattgcttgaacctgggaagtggaggttgcagtgagccaagatcttgccactgcactccagcctgggtggcaaagtgagactctgtctaaaaaaataaatgaataaaaataaaataaagtaaaatcaagcagagataggatattcctgggctctccacatgctccaggcactggttccagacctttccaacatgaatcctagtcttgggttctataatataacagtattcccctaaaaagttttctgtccccactttctgtttatactagccacaattagtttctgtcactaatgtaaaattattttctctatatgtgcaggtatttgtagatatttataataattttgctttagggcaatcttcggattgtaaatgggccttaaagcttcttaattcatggaaagtcaattatcctctagtttagtttgaggatacaaagggacaggagaagttaagctcatctcatatttcccaagaatgtaaatgtgatgaaagggaactttgcagtctaagcaaaaacacttggacaagataacttacggacttgagtgtaaaaacttaagaagtgaactttcacttgtagcagttctctctgatgtgagtcttgctagtccactcaggttttatttcttttagaaggtgatgcaaacagcaatattattagcttaaacctaaaatgtggtttatttaatgtaaccatgaccaactgcattttcataattctgtctttgctgcattatcagctggcagggttattcacgctggactagctctgagcctgctaattcaaataaacagtccttgccaaccactgctgagctttgagaaggtctaggctaaagatgggcaaattaaagacaattccacactgtggtaagataatcaactactctgattacctagtaactaagctaattgggaagcagtgtagtatatgggataagagcaggctgtgtggattcagacctgtgtgggaattccacctctgctgtctacatgctagatgacttcaagcaagttccctggtctttctgaatctcagttttcctgttgataaaatgaggtaataatagtacctacttcgtgggactattatgatttagtaaaataatatttataagacacagtaagttcttttttttattattactttaagttctgggatacatgtgcagaatgtgcaggtttattacataggtatacatgtgccatggtggtttgttgcacctgtcagcccatcatctaggttttaagccctgcatgcgttagttatttgtcctaatgctctccctccccttgcccccgactccctgacgggccccggtgtgtgatgttcccctccctgtgcccatgtgttctcattgtccaaatcccccttatgaatgagaacatgcggtgttgggttttctgttccaagacacagtaagttcttaagtattagcattattatggatattattttgtaaagcagttaccataatgcctagaatttgataaatgctatttgctcttttaccttaaaaatgtacctatccatatctttgaaacttcagtaagtaaatgtcttccctgatttacctgcctttgggcagcaggttaagaatccctgacataaactgaccttctcattttatagacagaaattgcaaccccaaagagtagcaatttttcagggttgggcagagctggtctggagcttaggggtctgtctcctaattcagtgctttacccactacactgcctatttcaagtgcagatgacctagggcattctttggctgcatcaatatgtataaagagacacatgatgcttgcaaaaggtacagttagagacttttacaaacccccaaacttgtggatatggaaatgcttatatactccttatttttccccaaatcatatttctataaggattctcatttcctgtgcacattccttttttatgtgaatacagttttcctgaagtatcttcccttgcttgatggcaattttttctttttgaggtggagtctcactctgtcgcccaggccggagtgcagtggtacgatcttggctcactgcaacctctgtctcccgggttcaagcaattctcttgcctcagcctcctgagtagctgggattacaggcgtgcgccaccatgcccagctaatttttgtatttttagtagagacggggtttcaccatgttggtcaggctggtctcgatctcctgaccttgtgatccacccaccacgacctcccaaagtgctgggattaccagcgtgagccactgcacctggccgatggcaagtttttacaaggaacctgagtttgtagtcacttcacaggcattacaaggacaagggaggaatctccaagttttattgccagaaagatgctgggcccttgggacctacatagctattctaaacactggatacatcaaccacagaatccaagtttgcatctcagtgaaatttcacactagaacatattctttggaattcctcgtgaataattgaaacaatgattgttaagtcctttaatgctaaatatttactctataatggtcccattctactggacattggtcagactgccatgttccattgagggtcgtatttaagagagctgtggccaaacctaagttcacataacagcatgcagtgaggatggaaaggagttctaggagttgagttatgtgagggatggtgtatttggcctgcatgggagatgaagaggagtaataaaaggcaccatcaaatattttaagtctgtcaggggaggagggattttatttactctatcatactggatatttcagagaggcatattttaggctgtttattttaaaaagttaggtgaaacttgaacaacaatagtaactataacaattaagtcttccagttattgagcatttagtgagtacagagtcctatgctaggtgccctccagggattgtaatccctgttttatagatgatgataatagatatatgtaatagatagatgtaatccctgttttataggtttgggaattggtccttaactggcaggtccgtgggactgtaaagcctcaggaagagcaattgcctccatcacagaaagcataagaggttgtaggaagaatagattctgtgggcacaggcctgccttgtattccactctacccggagtgcccagcactgggcctggcctctgccagtggtcagcaaatggatgtgcaatggacacatgaacagactctgcatttggtgggagctttgaattctctgactggacttgaaggaccttccaaagtcactgaccatttagatggaaataaaatatacatccccatcacttggctgttaaatataagctcgtcacagttaaagtctggcaaggctggactgggggaacagtggcagttcctgagagtgctgagggtgggattttccttacagttctattaattggatgtgtccagagtgatctcgtgtttccttgagaattgtggccacatactgccctaagtgctgctctctgcattttgtggcagttgatgggatatgatgagtttgtggggacaaaagactttaaaaggtctctgtgagaaatgactcctattgcctttgggtgagaggccaatttatcagaatagcaaatgccttatgttagtggcatactttgaacacttgccatagaatgtctcctttgatccttgatagataaagaagatataacccccattttgcagaagacactgaagctcagagaaattataggaattgctcaaggtcacatgaaattccaatctttctctgagctccagggtcagttatcacctgcctacttgataactccacttggatagctaatgggcacctcaaatccagcacgacctaaacagaggtcccaactcctgctctttctctgaagagcactgatgctctctgtttcagtaaatggcatcccagggaacccaggtacattagtcctattgctgctgcaacaaattaccaccgacataaaagctgtacaaatttatgatttcacacttctggaggccagaaatctaatgtgggtcagctgggctgcaatgcttctggagtcttcagaggaaactgttgtcttgccttttccagctcctagaggcttctgatattccttggcaagtggcttgcattactctgacctctgctttcatcatcacatctccttctctgactctggccctcctttctgactctgcttccagctttcccttatagggatccctggaattacaatgaggttcacctagatattccaggacaatccccccatctcaagatctttaatttcatcacatctgcaaagtccctttggcatggaaagtaacatattcacaggttttggagattaggatgttggcattttgtgggccaatcttctgcttactacaagggatcacccgttgttctttcatccagtccatcagcaagccctgctgggatctccaccaccaccaccttacctgccaccctcactcacctgggctatttaagccaaaacatcccatctcatctccctgcttccagccttgcctccccactgtctgttctctgtatagcagcacattaaaaatgtgggtcaggccaggcatggtggctcacgcctgtaatcccagcactttgggaggctgaggcgggcagatcatgagatcaggagatcaagaccatcctggctaacacggtgaaaccccatctctactaaaaatacaaaaaattagctgggcatggtgatgggtgcctgtaatcccagctactctggaggctgtggcaggagaatggcatgaacctgggaggcggagctagcagtgagccgagattgcgccactgtactccagcctgggcaacagagccagactccatctcaaaaaacaaaaaaaatgtgggtcagatcacaccactgccctgcacacaaaccctccaggaggtttatatcatactcagaaaaaatgtacctgtattccttctaatagttctgggccttactgtctgcccttattggccttacatttctgagctcctctcttccactctccgcctcactcacgctgttccagccctcttgccgtttaaccatacctggaacatgcctggaatgttcttcccttagacatctgcatggctccctccctcccttctttcatgtctctgcctaaatttagctctgcagggctgtcttccatgtcaccctgcctgacctgacactgttttattttcccatccaagcacttggcacgactgaccatgtattgtgtatatagtgcttgtaagtgtatcatctacctttctccctcagagggtagttccatgagggcagataatttgcattttctcagaaactggaatgattacttgcgcatagtaagagctcaatgagtatgtagaggaaacctgaagtttaaatctaggtcttctggttctgggtagaatgtgctcttctctcccccatgcgttatcttcataggtggttaaagaaaagtatgattttgtaatatcagcgaagtgtttgttttcctaacaccttccaaaatatcagtcagcacaggtcaaacatgcccctatgtctgctcagaggcaggcaggtgaacaagtgaacagctctctctctctcaagccaatgaagagccgtccactctctggcaaagcactgagctatttgctgagagtttcccaaggtgaaccgaagactccttgaaagcctccttcactggctatgcaccacttgtaattatgtgcacacattttgtaaccctttcatgagaggtgggatcgtgcatatagtgtttgcatatcccagaattgctccctgaccagcacagctttttgggtaagtttaatatgggggtgattatgcttgagaatgttcactggaccacaaggcacctcccatattctggagatgtgtgtgagctgcaaaaggggtacgtgagctccaggaacaggtagcatcatttccatcagctcagccagactctgttgtgcatatgcggcatgctgaggattgagacgagagctacagacacaaagctcaaacagctccagttgttgctctggaggagcttgtagtctgcgtcagtgctacttagagtggggtctgtggaccagcagtatcagcatcacctggacatttattagaaatgcagaatctcaggactcaccccagatctcttgaatccagatctgcattttaacaagatgtccagtgattcctctgcacattaatgtttaagaagttttgctggctgggcacggtggctcatgcctgtaatcccagcactttggaaggccgaggcaggtggatcacctgaggtcaggagttcgagaccagcctggccaacagggtgaaaccccgtctctactaaaaatacaaaaattagctgggcatggtggcagacgcctgtaatcccatctaccagctactcgggaggctgagacagcagaattgcttggacccgggaggcagaggttgcactgagccgagattatgccattgcactccagcctgggtgacagagcgaggctccatctcaaaaaaaaaaaaaaaaaagctttgctatagggaaagtgacaaacacataagcagataattactgtgcacaatgagattgtgttaagaatgggaagagtaggaagcacagctgcccagagaggagcgtccactctaagtgagtgtgtgagtgcattttttgtgtgtggccagtaagggggtaggtatagtgcttggtcaggaatagctggcagaatgaggtcatagctgaggtaatgtttgaaggaaggagtaaatattttaataatagtaatcatagctttcacctatcgaatactgaataatagtgtaacaaataatagtaaacacaagtagttcttagcatgctccaggcccaggcctactcattttaattttttttttttttttttttttttgagacagggtctcactctgtcacccaggctggagtgcatgatctcggctcactgcaacctccacctcccaggttcaagcagttctcatgactcagcctcccaaatagctgggattacaagcacataccatgacgcctggctaatttttgtattttttggtagtgataggttttcaccatgctggccaggctggtctccaactcttgacctcaagtgatccacccacctcagcttcccaaagtgttgggattacaggcatgagccaccatgcccggcctcattttaatttggaatgcatttgttttaaaacattaactcattttaatctttacatgtctaaaaatgaaaagaaaagaaaaggggcacgcagaatttagtggaactcccgactacgattgctggagtgccaggtgagccccagctgggcaattcaattcatctcgtgcctgcccttcctctttggggagactgccttgctgctgatgaaatggaggtagagagctgtgaagctgagtcccgttagcatccccgtgatgaacaaatcatgcgcattctttcaaggtgatgtgaagagatgactaaaaggttttgaaaagttccagatagaaatcttcttagatggcattgactgggctggggaggggcctgtttctgtgggtgagttgcagtcctccctacctgaccttgcgcaatgtagtctgtccctggttggggatgtgccgcactccaccgactgcatattaaaaagctgtattgacttattcctaacagggaactggctctgatttccatttcacagcagctgtcatctgctctactcttcagcaacaaacacggggtcagcctggccccaacttttttccctcttgtgatagtgttaaaaagctccctaactgtcccagtctttctttatgtggatttgatattctgtctgctacctaggcctttcagagacctccttttgatcatctatttcttcaggggtttttattgttgaaataaaacttgggggtaaaatatttgtatacaactattaatcttcattgtccaatatggtagctactagctgtatgtggctctattgagaacttgaaatgtggagcatctgaaccagatgtgctacaagagtaagatacacaccagattacaaaagacttgattaaaaaatgcaaaatatcccattactaacaagaaggtaaaatagctcattaataatttttatattaactagtgaatattttggatctattgggttaagaaaatatatcaaatttaatttcacttgtttctctttactttttgttaatgtaactactagaaaatttaaagtttcctatgtggcatgtgtttgtagcttgcattacatgtctctggggcagcctctctctaaacccatttgaccaggagcagccaacaaggtttccatctgctggaatccatatttagagtcaaaggtcagtcagtttaattccacacatgggatttttccctcaccccctcctccttacctgttccctggacctccttatcggatcttgttcaggttttgggcactgcacctattgattgatccctcagtggctgctggttggctctttgtcccaccttcaccatcatctggtctttctgggactcctcagcaggctcctctgggtgggctagccctaaatgtgagtgatcctcacagttctgacccctcctccacctctctcccctctgctcctcttccctggtttgggactcagattcacattgaaccttttttaactggcagggcaagcctctgtggtccatctggaaagaaccacaaagcatcctttgtcatcctgttttagtatctagaatacactctgaagatcagaagcagtctctctgtacaagacatgtgtttcccatcagcagacagcagactcttttgtagctgggttcaaaatctttgttgttgaccgcttctggcatcttagcttttgtgaatctggggtgataccttttggtttccctgccttttctttaacaccagatctccttcatcctgatgcatttttaaacaccagtcaggatatgccatttatgttcatgctaaagtcttcactgacactcaccacaccaatctacttttattcccagttactatgttagaatcctatttagatagatggagccaattgagcgggccctgcagaaagccatattcagttagtgtaaatcttcctgctggtgttggagacagcaaggtcccctgggattctgtctggaaatcttattggattttcaagacttaagttaatatagagaccccccaagatagtatagggcctcatttctttgccttgaaagatgtttttagaggtctgtctcaagagtctcgctgataaggaagttacttcaaatatttcaagagaaacaaccacaaagagtcttctattttctcaatattttttctctccctgcccgtccatctttttagtattttttaaatgcctgccctctatatttatttccctctttctctcatgcactcattaaccttaggcccctgtttcaaatggaattaattagtaaccataaaacttggtaagtgatggccttaagggaaaagtctttctttcttctttctttctttcttttccctccctccctccctcctgcctttccttccttccttccttccttccttcctctctctctgtctcgctctctttcatgacgaatgaatataccttgtagacataagtgaatacatttcatgatactgtacttttttcttttcttaatcaagtgaacatcttccttagtgacatatagggtactgtctcctgacttttgctctgagacgcagcactcagcagaacagagtgtgggctttggattcagagccataagtttgagtcccagctctccctttatgctgggcaaacagtgtcgctcttctgcagttccattcccatgttagtaatataggcacgaccatttctgccttgccatattgtgttcagaactaaaggtgattgtgcatgtaaagtgcctcactcccagtgggctttcaggcatccccaggtgctgcgttttattcagttaaaaaagtcaaaggaagagtctaaacacctcccaccagggtcgttgataaatatcttgtctcagccttcttgagtccagcaaggatgtgaatgtcataccttcagtaaactagattttgtacttctagaagacttttattaggcacataagaaaatgatgctaacaaagttcaaagttgctccgtgttgcagtgatcttttaaaagggaagttttgaggtagttttgaagcagatttctggaatcatcttcaggactttcgtgagctcattgtaatgtgttatgtgaaatgcatgtcctcaaaacatgggtggttgtataaatgaggaagctggcctcatggagccaaagcagcatggaaaggcccaaataacttgctgtggggaagactgactgcctctggggtttttaatcagcatgaaaagccacccagggccccaaatcattagtagcattttaattggcagcagagtaatactgtgtctactttggcttaaagatataaatttcctgctctctcataacagatggtgatgaggtgcatggtaggaagcatggcaagaactgtgttactcaaaatgtagacttaattgcaaatttgaaatggaaataaagtgaaggttctgtctttatttacaataaatttcatgtgttaaatggacttgtctaattcttctattttaccatgcgattgaataataaacatttattatgtgcttctggcatgcactgtgttaaatattttacatggattatgtcatggatctcttgccatgatcctgaggaaagtattattgctgcttttagtagcatcgaatgttggaataaagtctgcaggggcagctggtaatatgtcagcaatgtctgtcttctgagatgagacagtgataaaagggctgactgcccacctagggaggcagtctcatctctcattagtgccaggagccatagaatgtgagcctggaggctctcaccaccaggtaggtgaccctgtgcacaccctcccattgctctcatcacattagaatagcatctgcagtctttactctcacctttaaggccctgcatgacccagcttcatcttctgctattctccctatgttctttttccttcctctgcttgatgttcctatgtagcagttattcctacctgagattatgttatgtgtcaaacaggaagatcaggctgccaatcccaggtggggattatcaacctgtggaggatggcaaagagtataacaccaccaatcacgagaagtcggagcccattgaccttggcccctgcattgcctatgggcttggaatccccaaggagacctcagcatacaaggtgcttgttggaacaatgctttattcacagaaaggagaaaaggcacagcaagatcagcatctgcagcacgtgccagtctcccatggttagcagaactctccagataaagtggaagactgtacccaggctgctctactgcaggagaacaccccgttccctcctcaaggggagcagatatacaagtggactggccaaatgccatatgatgaatacacttaagcggtagcagaaagttgtgtctccagaacaaggaaaaacttctcccagtgaggaagaagaatctaggagccagtggcaactccagatgagggaagtttcctggtccaggccactgactgggcaatcctggggagggatgacaggctgagcaatggctgcttccccgacagcacatccccagaccttcatcaagatgccaggacaaaaacctcaggcatgtcacacccaacagaacaaacagctcccccaaatatggagtgcttccatagtcaccaccgaagatggaggtgttttcagcatggtcctagaatgagtctcatggctccctgcccaactgagatagcactttgtcagggccagtccaagaaagatgatcaggcctccctggttctcagccctgagccccaggtgctgggatttagtcagttaaaaaagtcaaaggaagagtctagtggatacacaggtttacagacaacagccaccctgtttgaaggtagattgcttttcctgaatacttgatgtacacacagcaagatacgttggcaatagcatggactctgccctggagagtcacccaggccatctgtcctaacccaagggctaccacctctgcaggaacacattgctcttgctgtttccccaaacctctctgccctgatcatccaatcgaggcagtgaggttatggcttgtacaaattttgcgtgtcctataacatcacccacctgtacaggggagttgggagttcctgatgctaccagggggattttggtattgtggtgttttatgaccctctcctttcctgtggggtcccaaggaggtgaacaacctagggcagcataacttccaagttagagtaagggatgggcgtccctgtcaggcactaccactgcagggaccacagaccactccgggcacagtgttccagaaggagaaactaaaggagtggttgggtacacagattgggatgcctcagtcacagcctaatcaggtgactgcctgctcctctacccctgccaaactcaggattctccagtgtggatttcagtgccgtttccctttgtctggagtgcagtgtcaagagtccaaatggccccagtgaggtgagggtatcaccctgttaacaatccttctttacgtcccttctttaactgttgatttagtcttccattccactgttctgtggctctcttagcttatgggtggtgtgaatgtgggaggtgcagcatatgccatgggattgtgtccattgttttgtggcttgtgctatcaaagaagtgccctgatttgattggaattcagtagggtacccaaactcatggcaaagattttttttccagggcaactatggtggtaccagcattcacatgcagcacagagatgacagttctaaaccttaagtaggtgtcagctgctgtgaggcaccagaagaatccatggccgggtgttaaagatccagtgtgatccatctgccaaacgagcctgctgatacccctcacgataggtcatcattctcgtcatactgtttgggctgattggtgggaattgcactgcattcttggcttctgtgtcttctcggattacacccatggatttggcccattcctgcatttgagatgggattccatgactggttcattaaggcacccagcgtgtggcccttccaacttgttttggacaggctctgataccttaggaattccccttgtgttcttatttaagaggcactttgctgggagcatatacatgagtgataaagatttgcctatttcatgcagcaaacttgccatagtccctgttcccacacagatttttaatagttcagtcatgtagttgccagtctcctgacgaaatggctagaccaccacccaggaattggcaaagatgtagcaaggtgtgtggggtagggtggcttgtacaccattaccaccacatgaaattcagccccgtgggctaattgttctcttccagtttcaggtaagaatggctctccatggggtgggtggctgtgggggcacagtggactccatcaactcattttgcagaagcctgggtaaactaggccatgccttcagctagaacctcttcaacatggcccaggtgactagggaagggaccagcactgtgctccctctggcagggtggccacctgctcatgtagttgaccccttggggtcctggcctggctcagtcttagatgtaacatttccatttgatgatggaaccctcctgggcttttccagttttattagtgagattggtgaggacccaagtaaggatgagcacttgaggcctcagaaccacataatgtgctttggtagtgagatgttcagtctccaccagagcccaatagcaagcaagaagctgcctatgaagggtgtgtattgggcagcagcttcaggcagcttgtgtgtccagaatcgcagaggttgcaccccgctcagaggtggttttctgctgctactgactcagcatgttgggtgctgtggacatttgaagtttcatgcaggctccaaatatcccactcagagtcagggcctgggccatggcttgttgaatagttttcactgctcattgctgagaagtgccccatttgaaggttgctgtcttttgtgccaccttgacaagggggccagaaggatacccagatggggtatgtgttgtctccagtgtctgaacagatccaccagctgctgtgcttctattttatcagtgggagagccaggggctgtaacttctatttaaccttctccgtaatactctgttgattttatgctcagatgtccctgagaaactgtacttgttgggtgggtccttgaatcttatctggatttatggcccaactggtgttagtcctcgcattggtgatcgagcgaaaagccaaggccacttgttcttcagtgggatccacaaagaagatgccatctattaaacctgacttgggcttgctgtaaatcaagccctacccattgctgacaaatggcagggtcatgaagggacccctgagggaagacggaaaaagtgtattacaagccattccacaggatgcacattgatcctggtcttcttgcccctgggaaattgagaaaaaggcattggccaagtccgtgacagcataccagtctccagaataagctgccaccgactcagaaaaacgggatgatcgccagcactcaggggccaaggcatttggcctgcaatagtccaagccagcctctggggcacggaggctgatgtagtctctcagtctccctgtgttggtgacctttttgaccaggatattaaattgtgacaaagttgtttgatgcactcctgcttgcaccaggtaatttattcttgtattaaaagagtaatgtctttctttccacaatggataggggcttgggcaattctggaaggaggaagaggaggagtgtatttggcccacatggcttaaatattgctctgggtaggtgcagtgcatattcctgcaggtgaccctggttttcagtgtcatggctaccaaaatgtcattacccatagcacatgatgcaaggggtaccatgatcattgctgccgaaatggtcttgcccataagtacatgtttatttgttttctatgggctaccatgccctccccaaaaacacacaatgccaccattccactcctcccttgtgggggcttggtataataatcactaagcaacagtgtctcatagccccatgcttgttttcatactctcccccacttccatatttcccgtccacccccacagggcacagagctgcaggtcactgtgggagcgtggagcctttggccctaccccaatcattctttttaaaaggagtcagaatataggtagcacagctcctcctctttatctgagtctagctcataattggaaccaccattttcctcactatctgagctgggtattgggaaactccagcagcagcttgccttccctccagtggggaggaggggggagtatctgaatcttcaggggggcaatccaagactcaaaatccttccaatccggtgagctcccctcttcctgttccttaatggtctgcatgaggtccttcatctctaatttagggggttctctttcctctttatgtgtggacaaaggtcttcagtggagactgcctatctgagtcttatctatcctttgtttagaagccacaaccacattgcactgcacacgagtcctgcccctctgattgtctcccttttgggcccttggaggaccacttgtagaggtctctactgctcaggtctcatccacagctacagtggcttccaccttgcagctccctccatcagatgatgggacatggcagagatgcgtctccaccacctcgctcattgtcatcccagggacagaagaagggacaaggaagtcttccattgtgggggatcctgcctcttaaaggcctctagggctgtacaagataggacagcttcatctacgtcctgtctgggggagggtcatacagccaggtgtcaatggcctttatcttaatggccataatggttttctgaaccattttccagggagccttgcttccaagaaattcccctacagtagcatacactgtgattatgcttccagtcacccaaaactaatagtggcatcagtttgtctcggtcaggtcctgttagttattctctgtgatgtaggtgaaaatatgctatagtagggggatgggttgtcaacttccccaaactacatctttctgctggagtcacttgggtctgcaaggccccctcatccatcaggcacaccaaccaggtagcttgggactctcctggcctctgcccacatctattctttaatttccttatcttgctgccagaaattgagcacatttccatggtttcatcttcagggacaccattagtcctttggcattgttggaaaatggatctcatctgcctgtggctgcagagcctcactggttggagctctgtcctaggggccttcagtctgcattggagctcctaattgttgagccatcggtgtatcagcagtaaagtggccagcagtcaagggatagttttcctgctcgtcttatatctccgccatgggttccaccccctgtctctccaccatatgacccattggcccaagtcatcccagtctaagggaagatttggtaaatctcatttgtccacctatatccagagagtggccaaaatttctgccagctggttacccgctggagagctggggacagaaacataagcccttgcttttggtgagaccgcagtaagtatctttggcaaacctgctgacttccagaaactgtgcagcaggaagatccagctgctgatctcaggggaggattccattcatgtgtaggacagcagagagcatatattgttgacttccaggaggaggatcccacagacttttgctcactgcatcttctacaggtttggagtcaccaagaaggactccatgcacaagggctggttggaaaaacactctacttacagaatgacaagaagatgagcccctcccgataaccaatgcagggtgatagcctgcatgcagccctttaggttacaggcaacgaccccaatcccagcactccatctagtcatatagataagtggagctgtccaggagccattgacacatgtttaagcagtacaaggaaattcaccgtatacccagaacagagaaatatttatccaaataaggaagaagactctgaggccaaggaatagctggacacctggcttctaaattagggaatgtcccaggcccagggcactgattaggcaatcctgtggaatggcggacaggtcacaagatggctgcttcctcagcattatacactgtatgtttatttcttttcttcccctatacattctccagaaggcaggtgctttgctcacagctgtatccttactcattgaaactgagtaatgtctggcttatagttggcactttccatataaattgttgactgaattgagaatgagtaaatgcccttcaccttttccaggcctgaagctcctagtctatgagatgagggcactggacagatgacaccggagttatcctccagctctaacattctgtcactgccatgctgtggaggggtgtcacacatcagccagtggtttaaccatgggttaggagacaggtcagagacaggattgggctttttcctgctcagttttcagatgtcccttttccctcatcttttcttccctgtgagtcccttaggtgtgagcccctctagaggtggccactgcttgtttcctgtttgtgccctcctgacaaaaggtgcagcacctgaactcctgcatgggtagtgttttaccagctctggggcaatggctcttgccttgtgtctgtgtcatgaaaagcactgtcttcagacagactgtctctttcaagaacgctcaggctaagtaactacctgttactaaaactataacattttgccattataaaagtaatactttctggccaggtgcggtggctcacgcctgtaatcccagcactttgggaggccgaggcaggcagatcacctgaggtcaggagttcgagaccagcctggccaacatggtaaaaccctatctctactaaaaatacaaaattagccaggcgtggtggcatgcacctgtaatcccagctacttggagggctgaggcaggagaatcacttgaacccaggaggcaaaggttgcagtgagccaagatcgcaccactgaactctagcctgggcaatagagcgagactctgctcaaaaaaaaaaaaggaatactttcttcttaaaagtaaatttggaaaataataaaaaacttgctaatatgccctccatacaaatgtagcatggctaagatttagaggatttgttcctactctgttttatgtttgtttgctttattgcacaaagtagtgttttgcatttgtgttaatctatatttttttaacttagtatgtaagtatgttccatgttgttgtgtgacttgctttaaaaatgaaccaaatattgaacatctactgatatgatggaaactgaattgggtatttttacataaattagctcatttactgcagcactctagtgaggtggacattattatccctattttgcagttgaggaaacttaaggctcagactgtttcacctactcagatcaaatagctaataaggaccaaagtcaaaattcattggacatggggctgacttgaaaagcctgtgttcttttgggtatgcattttactggctaccaaatatcccatctatcatgccatgttgtgacgcaaatcgaacatcaggtgaggggccccatagtggagctacctgtcacccaagataggatttctcctttcaggcaacttcttcaaagcctaattcagcacacagacatcaggtagaaaggtgattatttcctgcctggataggtttccacccatgcggctctcctatactcttaggtgtacattattgattccaggagtcatatgtgtccctatctgtgttgtgggtaaggagccccacagtcttttctcttgaaagacttggctctggctcagctgtgccttgaatctgtgattctgtcgcataccccaggcttttctgctcaggatggggcccttttgagaccaggtctttggtgcttgctcatgtgcagtctggaatcagctgcacagggctgggaagctgcaccgcccacctctaacaggctcacagcagaattcttaacacaggtgctttattttagaagtttatactcttcattgtaaatagctaataaaaagcgacagctacagcccatttataaatgcacttccagaaaccaaattcaaagggtttactaaatggcaggaacctggtcaacagctgttttaaatgcatttatttctgtcgggaggcaaatgttctacaaaatagctttgttgtcaatagtctctttgttctttgatgtacagcttacaaataaatgcatttataggaactgctaatgtgtgagggttttgatattagtgctaaatttgcaatctataatatatcatctagtcatctttgacaaactcaattgtaatctaattaagtggcgtcttctgtgattctgagtagagatccctaaggtaattctatcctacttggttttcacaggagaaaaaaaaaatccctaagagtactgttcaacaaagtgtgtgtatgtgtgtgtgtgtgcataaaatattccttttagatgagcaaagccaagaagatacctagtaataaatagctttcacagttggttaaatatcagaactggggaggcatttgaccccgaaatcatatggcatctctagagcatggcaactctgggaaactgattgttgcttaaagaaagtttaaagtatttgggaagtaatttctcttttatttttactcccttaggaagatttggatttgcagcctttatcactaacttggtgagaatttttttgtaaagttgtcaaatctataggcctcagaaatggcagttctcatacaaatcccagtaacgatgctaacatcattcatccagtgtcagtcaatcctaggtgcttgaaaaacatctcatttagtctttacaatagcttatgaagttgatacttttgtctcagtctttaaataagaaagccaaaactcagattggtttagtgatctggtcaatattacagagccaggaagtaagaggaggaattgaaaacaaggtctgcccgcctgggagtctgtgctgttttaagtcactttactgtcccctgctctgccacactgcctgtgttttcagagaggaggcaaccactaggctaaatgactatctggcaaaaatctatgtggagttggttcttcctattatattgcatctgtctgggacacctgagtgtttgcagagattcttgccccgattttcagcaccctcagctgttagccgtgctatggatgtgatgttggggaatttctaagattgaagtggccagttgcatgtagatgagaagactttctttaatttgccctaagtagacattctgcgcagtcagtgtgttatagaaagacatttctgggaggcaggtgatccaagggatggtggtcaagaagcacagaatatatagagatgggatagaaacaaatgcaatgaaagatcaggacattttgttcaaagtagaaatttcaagtagggaatcttcctcccacctaccgtcatgaactccaaggagattatgatttaataatccttgtctttatgtgtattcttcagtctatgagtaaaacatgttactggtttctcttctctgtaagttgcagtcatgtccctgcaagggagctagtttgtatgtattgctaggggctttaagatggtgattctccaggctaggaacccttccaagagattctatcacttacccaaagccgaaacacttgtccagtttagcaggaaatatctatatgattttgaatttcttggtttcggccatttgtggctctgaattcactgttgccctgaggaagccatctctgacccaaacactccttgttaaaccactggcatagctcaagtgacttggaaacctcactgtaactactattgcataacttcaacaacaaaccttcattctgttgtggtaaaacttcgctctatattcagccacacattaattagtacttatattttcttaaatgtacactgtgcatcatgacatgtcctcaggatatggagataaaatacttcatttttgctctcaaagacctaacagtctagtgaagaagactgcattctgaagtctctgaatgtcaaaaagtgctggttgaaaatatttcatttttttgataaacatgagaataggtaaaatcattttcagaagggcttatggaggggagacatctggtcctttacaaagacagggtcactgaacccttagtgcttttgtgaggtgacagaacacagtgtccccagagtgatgtatttccttgaaagttttttttctttgagaacatagggtggggttcttcctgaggaaaatattgatattgccagcctgctcctggtgaaattgaaaaaaaccaggaaatttaaacaaaggcatgattcaagaccaatatttaggaggaagcactcaccacaggaccagaacctgacccatggacccttgtactctgcatcgctgcagttcccatgctcttcccagcacctccctaaaatgggtcattctatgcaaatcccaacagccttccaaatagaatgtcactgccctgattaacaagtatttgtatactttttctctaaaatgtctacttgacatatcatatctttttgtatgtttcttccagcttctatttgttctttagaacttcagtagagtgcctttttacatttaccaaacaatgcaaaggacttccaggtaagtggacccctagtaaactctccagtgggatagatgcatagctttgtaatggcagccaaaaccagtttgtaaagatctcattttccccttttttacccctgagaataaaaggaggagtttaaaaaaatctatgcactggccgggcgcagtggctcacacctgtaatcccagcactttgggaggccgaggcgggcggattacgaggtcaggagatcgagaccatcctggctaacacggtgaaaccccgtctctactaaaaatacaaaaaattagctgggcgtggtggcagacgcctgtagtcccagctactagggaggctgaggcaggagaatggcgtgaacccgggaggcggagcttgctgtgagccgagatcgcgccactgcactccagcctgggcgacagagcgagactccgtctcaatggaaaaaaaaaaaaaaaatctatgcacctacacatacatgcacaatcacacaaacataagcacacatatatgcacacttaagcacacagattcacacatacattcacaactcatacatacatatgtatatatatagcactcacatgctcttacaaatatacatataaacatatacacatataaacatacacacatagaaacacacacacatataaacacacacacacacagttgtacatggactgtttcttgggaagaaatgctcattcggcaacagtggcttctttttctctctttgtggatttgctccttggcctttatccctataggaagccaagctgaaagcttttaaactggtatagcttttgtcctgacacctatgtctgggtgacatagattctcagagagagggagagatatgaaaggaaaaaagtctctgaggaaatcgtaatctttcccgaagaagttcttgcctagtgccaggtttctgggctcagagcagattagcgaaacaagcactcagctaagagtccagggcctggtttctagttctggttgtgaccctaatcagccgggcaagtcacttatgttctctgagcctcagatttctcgcctgtgcaatgatgatctttcagattctaactctaaaattctgtgcatgtctcttttccagtgactgaggaagttcaaagtagaataggatggggatgacacatgaataagctctgaatcctcacctgtctcgaggaggaataaattcaatcctaatgccaaaacgacagaatctctttacttcctcactgctttgccaaacgctcatttagatgtatctatcaatcactggtttattcatatggtgcctctcaccgtgaaatctaggttctggaacaatataattggcctaattttggttttctgactgcagaagtggatgcttcctctgcctgtctctactctcagctcttattgttttttttggtgaaagagattaatccaatgctccgtggaagtagatatcaagaactcttgagcagagagaagttttgcattctgcctgtttgacatttacaaggtatttcattaacactgtgggcgattcaatccccttttatttttggctgcccttgctgtgcctctgaaggaaggaaggccattcttttgccaggtaaggggcaggaaaatgtgtgactccaaagctacctggagcctgatgggggttaggttggtccttgctgcccctgctggtcacatggtccctgcttactctgcttgccttttgtcttcctctttgtggactcctattgatccttgtacttcctctggcagagtgtttatcagattatattgaaattgcctgtttacttctgcctctcccacagaacagtaaaaacctcaaagactggggctctttctttctttcttttctttctttctttttttttttttttgacaggttctctctctgttttccaagctggagtacagtggtgcaatcacagctccttggactcctgggtcaagggatcctgccaccccagcctcctgagtggctgggactacaggcatgtaccaccatgcccagctaaattttaattttctaatttttttttttttttttttttttggtatagagggtcttgctaagttgccagagtgatctcaaactcctggcttaaagtaatcctcccacccaggcttccaaagtgctgggattataggcatgatccaccgtgcccaggcttgttttttattgtacacttagggacttgcctatggtaggtactcagtaaatgtttcttgaaataattaatgacttgggttgatttggatgaaagacggaatggacggagggcattttttagtagcctggagacttggtttccatgcaccatgctgggatgtccctggcagcccatctactgagctggcaccagcatgcttaccagtctcctttgtgacagtcccaatggatatttttattagccagcatgatttatttcataatgctgagttgcagcacccttcatggctagagatttttgctgtggagataagttcttagaactatctccatttccagaaaagagagggtttctctcgtctgttgcccagaaaagaagtcagtttacgtatgcatcttccctgggtcaggctaagaagtagccccagcactggcatgctagacttggagagtctaatattcttccagccaaaccctgaagcaaaccacacctcctaggtcctgcaagtccccattaagtgtgcttaagtcatttgaactcctagagaatccatgtcagaggaggagaatcagcattcaacaaaagatagcatgtagtttttttttaaaaagtgaaagactaaagcttgccttttctatagatcatcaacatgtttacttatagcaaaaaaagcatgtacagatggatttttgccatttaaatcattcattaaaatccctattttaagccaagatttataacaaagtttttggggaaataacacatacatcccctcccatctggaaatgaaaagaacaagcaaaatggatctagcatcttcattataatagcaccttagcatgtaattcagtctcctcatgacaaccattatgtaaggataaggagaggctctgcaagccacccatttctacactgccctagagttgagattcaaccaagacccctgcttcggtttaggtttcaatatacacgtgaagacagggaggaatatactcacaagacaaagtcctgtgctcattggcacctgatcaagtgctaaggcttcagatgaaaagggcaacagaatctccagggcaaagggatcagttagtggaggattctttagagaggagggaagagaccccctgctgggccttgggggatggagcatttagtcaggaagatgacatcccagtaaggggaagctacccctaaaagcaaaggtatggagatgggagggaatgcggagaggggtggagaaattccatctttgttagggcagcagtcaaggatgagtgagttagcctcttaaggaagaggctaagctgttagaataaagaggtttacaacatcagcggcttaaatcaaatagaagtgtgtttctctttcacatgacagagtagatgtggcctggcgtctagaaagcatatttgtctctgctccactgtgtcttccagggacccattcttctcttgtcttcatgctccatcacttcctagggtgttgtctacacctgcatagccatagctaattttccattctcagcaccaaccaggggaagaggaggaaaggtagcctccttttcatgataggtgtgaagttatgcaggacactctcagggtgaatggaccacagtgtggctcctgactgggcagggaggaagaatctgctgctagagaaagaagggaagacagtcatctttgacatcatgagttgcataagatgggaataaaaactggaaaagacctaaatcaccatattagaaaactctagccattctaaagacattgaagaatcctgtttggacctttttagcagtgaggagcgtccagctgtggttatctggagaatgcaataggcagaacttgctggtagaggccccgcttccttgtcttgaatgcctgcctttttttttttcttttaaatttttcatctgcttctggatcacattgctgtgagccacattgggtcaattcacatggaggattagatctgggcacaccgtatcttttatgtcttttatttctttgactttattctgctggaaagtgttggcccacagccagaaccggcagagggcaaaggagggattactttcttatcacagggaaattaaatgcctgagacagcaacatagtgatttttttaaaacaaatttttaggaaaattgaactcaccctgtttactttcatagaaggcttttgggctgtgggaaggaacctatttttgtacttaatgaaatggatcttggcagtaaagggtttaaaactaactttggatttatttaaaaagtaatatccttgccactaacttgtcttctgtctttaaaggaaagagaatttttacagtgcctatagagcatgccattcctcaccagtcatttggcagtcctattagcaaactcatttgtcaaagcctcattaggtgattgcaaaagtactctcccaggacccactttggacttcttaccaagtcgtgtgtgtgtgtgtgtgtgtgtgtgtgtgtgtccgtctgtgtgtgcatgtatttgaaatggaagtgtgggaacatgacagtgtagacaagcttacagcccccatttttctttgagtggccccctctgataaaaggttatatactggaagaggacttaaaacctttgaaaaatcaaattctcttggaatataataccaaagtgttgttgttgtttttcttgcatctacatgttccatgaatattttccaaacaattcaatacattactcttcagcccacgcccatgctgacatcaaaaacttttgggaagaaaaattgttatcgaatagcagtgtcgcaccaagcagatggggtcactgtcccccaggataaggcatttctcatgtgcttgagaagaagactgtggatctgaaaatatgataggggctgcggcttattgaggcctcactattgagagggggcttggagttatggggaacagtgggctctagtgcaggactgctggggtcttaagcccactggaccacttcctagcttgccagccttgggccagtttatagccttttgggcctcagtcttcttatctgtgagaaagtgtaatgtcacctcccatgtcactgtgagcagtacataagtggatctgtgtaaatagcttggagcatcatgtagcatgtggaaatgctcagtaaatgaaccaggtctctcaaactctagggcccatgtttttccccttcaccactaaaacctcatgagaagcatgggctcaggagtagcaggaggcttctggcacagaatgagaagatgggaaagcgtgctgcttggccacaatggaaggaggagaaaggtcaaggagctcggtcagtaatccccactctgaggccaaggaaagaggatggaggaaagggcaaccagaacatcaaataccacataagcaagaagccataagtttctttccaaactaacagttaagaaaacagacctaaccacttctactcagggactacatcttatttgtttttgtatccatagtgcctggcctctagttgaacttgacaaatattggagtgtgttggcctgtttcttgttcactcatttgttcagtcattcaacaaatatttaagtgcctatcatggaacagccactgctttgagagcttacaatcaatgctgaagaaaacaacacggaaggattccccctgccttggcttcacctgggaggggagatgggcagtgagcccatgctagcttctaatgcactcaccacttcttttaataaatacaatactctccccgcttcccctaatgattctgtgaagcaaactagtctatagttcctggtatcttcttttcttgaaaagttgacatagatgacagttgtgtcctgaagtctgatagcttctatgaatttctcaaacattggttaccaactggtttggggatcaccttgacaaactgtgtaatttagaggtgagggcctcctttattggagtcaggagacctcttggatttgtgtcttcactctgttatgagttgagtggcctcaggcatcttctgagtttctcattcctttactgaaaataataatgcttatcttaaagtagcttgttcagaacttgccttgtctcaagaatcagccagacatttataaacaaatctgaatcctgaacgtcaacccaggcttgtctaagaattctcctctttataatttttagctgctcagagtagagagcctgtcaccaaccctcacactgttattacagtttcctgtttctccttaacatttattccaccacattttgcacatatgactttagaccttgaactttcaagtctttctagaccaaaggacaacaatgctttccagagagtccagcaggaatcacactgggaaagctaaaaaagcaactcagtccttttcacccagtctatttcatccaaccccgctgcccctccttgaatcctggaaggatcatctattgcctttcaactcaaagtgtgggacgtgtactagcagcatgggcatcaccagggagcttgttggacacgtggagtctcagactccaccttagacccactgactcaatctgaatcttgacaaggttcctgtatatcatgcatgttactctttgagaagcaccagcctgttgaatacctctgggccaaaatactattcagatgtgttgttctttttcaattacggaaataattagtgacttaaaactcacttctgattcaggactgcatggctgtttaagtcgatatgtctgcgttaatgctgttgtaatgacatcacagaattgaggcatttatgaactggagagtaaattctatatgtgtttaaaaattagataaataagaatttacatgacagtttaataggggctttaaaaatttaacacggataagtcatctgctttttcaatggattttcctgaatagtgggatcacaaaagaaatttatgtgtttttctaagtttctttttcttttaatgtggatttacaagtgattaatttaaaaatttgctctctgattagcaggtaacatttataatctggacctgtacctaagatagcttagcaaatgaacacaaatggcttactaggtctttgcttttgaaaacgtatggccatctaaaagtagtaaaggcaatttaataaatacagacaatctgctaagcagccaaggaaaaaaggtgcctgaattatatatgtctgcatgagtggacaagacgtgcttttcaagattaatgatttaagctgttctttacgttcccagactgattaaacaaggcttaattctaaacaacactttctccttttcttgcttcttcaaaattcactgtccttctctatcccttcaggattgattgcaggggtgatccaggatggtgtctgtctaaagccttaacttctctcccttcataaaaggaagattatcccttttttaattccttgttttcattgatgtcagatgagaggcattcagaaggagtgttagcattcactgcactttccctgaaagtggctcaacttttgattgagatgttcttgaagattctgttagtggcatcttggcatgctcctgtcctctctgactttgacggctcctcccctcctccttcttttctccctcacactcctgtccacacttccagtcaagtgctttccagagcctgtcattcagtttcttttctctctcccaaatccatcgtcttttcccaatttgtaggattttttctttttccctcttgttcagcatttcataaagttagtcctgccaggttttaataggggttccacccccctcaccgctaaaaaaaattgatcaggacaaagtataaaatattaatttagacagttaaatatcattttgtttgttggtttagcctcaggacaaattagaacttttaatatgctgccaggaggggttgggtggttttctcatttctgaatttatttccctgtagaaccttctttgaaagtatctaggaagaccagtgtttgatgaaatgtactttccgacctcctccttgacatctctcctacatgcttctctccatctcatgctatgtctaatgactccgtgtactgctccacgtgtcacatcctcaaatacatcctaaattaaacactaccaacattagctaacttctactgatcactccccccacttctttttttttttttttttgagactagtctcactctgtctcccaggctggagtacaatggtgccatcttggcccactacgacctctgcctcctgggttcaagtgattctcctgcctcagcctcccaagtagctgagattacaggcacctgccaccatgcccagctaatttttgtatttttagtagagacagggtttccccatgttggccaggctggtctcgaactcctgacctcaggtgatccaactgcctcagcctcccaaagtgctgggattacaggcgtgagctgctgttcctggcctgatcactcacttttactgctaaggcttttaaaagtattttgcctctttgattgtctatgaaatcaagcacagatatcttaacctgagatgcaagaccatgtgtgttcttggaccaaccaacttgcaatcaatcttcccccttccccagcatttaacattcttctccatgcttgatttttctttatgacagagaactttacccctcccaatattctataccgtttacttacatattttgtttgtcgtctattttacctcaactagaacgtaagctccatgagactgggatatttgtttgttcatgctgtgtcccaagcacctacaacagtgtccagcaaatggcaggtgctcaacacgtgtttccaatacaggcggaatgaatgagggagccttctcagtttcatctctggcctgtgcttggtctttattccctactcttctcttgcctttttttcactctcttttagccctcaatcttcatctgtcatcatctctcttcacccctcagagcctaactctctaagtagcatttcttccaaggagccttctgtattcgtgacccttctctctttgtatgggtccctgtctttggaatgttgttgtttatacctgttttaccagtcagttacattctgccttgtagtagagttccttttaagctgaaaaaggataatggggtattcatgtttgcctcttacatcactgtggaatatgctcagtaaatttataattaatagaacaaacccaacattgtgcttccaggaaagtaacccccacgtgtgcctcagtctgtaccatggggactgcttgacgcatctgtttcctcagttgagcccttaagatgaatgcttgatatcctcaagaggctattaacgagaatttttatttccccaaagtttctttttccctaaaaggcatttctttgatatataacaaagctctgttataaaaatttcaactgctcatcccagtaggagagaatgttctacgaattcagatataggaaggtttccggggctatattttcttttctttttgggttttcatgttcacatttcatctacatttcccctcttgggcaaataggttgcccaatttagggcaaatttgtttggttttccttccgatatctttatttatttttctttattatttgcttcctctcccttccctccaagagagttcagatacttaccacaatggataaacttatgctgggaaattgcaatgcttttctttttttgcaaagtacagacctcatgtacatatgaaggctgctgacactagctttccatctggccacaggaaagtgtgtcatctctttcttccattgcctgtctcctgtccccaggggcctcagtggaggccagacagtaacttttctctctttcaaaaacccacccaaatccccagaccctttctaatacagcttttccacgtattcatgtatcaccacctgaaacttgttccattctaagttaaggattaactaaatgaatgaaaattgtatttatttgggagacagaagtagcaaaggcttagaatcaggcagacttgtgtttcatcctcagattctcctatttactcattgtataaccatagttcagtcaattcccgttgccgagccttagtttctttgtctgtcaaatgggtataacaatgcttgcctcatcatattcttgcaaataaggtcagataattcatgtaaagcttggagcacagtgtatggcacctggtaatcggtctctctatgatgaagatttgctgatgctgctgcttacttttctggcttatggggcttaggttctgaatctttataatctttttgtgcctgctgcatatggtcaaatcatgtttgtttgatagacagacatgtggggtttttccttaacaagccattcaaccatgtatagtgaagaattgctcatggttggtctgttttccatgtctagatattagaagagaaggctcaaacatgaggttactctctgtagtgcagtgggaaagagtatattcccagggagcctggcatcccccattaatctgtaagcagacctataagcaaaggaagggctttaggataatccccacttccccgccccaccagctttattgaggtataactgatgaataaaaattagatgtatttctggtgtacaacatgatatatatatatgcattatgaaatgattaccacaatcaaagctattaatgtatctatcagctcacatagctgtccctccaggttcatccatgttggtgcaaatgacaggatttccttcttctttaaggttaagtaatattccattgttccattgtgtatttttatcacattgtgtattcatatttctgtattcattcattgttccatggatatctaggttgtttccatatctttgcttttgtgaagaatgatgtgatgaccacagggctgcagatacctctttgagatactgatttcattcctttggatatgtacccagaggtgggattgctgggtcataatgccattctaggagttgttttgcacgttgctagatgtttcctgaatgatatgagaagattcttaaatagagggaacctccctagagccagagctcacctggttgattcctcctaggagggacatggtggtggaaagagctctgctgggaagaatggggactcagctcttctgcatactgcagtgtgactcaggcagacactgcacatttctgggctgcgtttccttctcctcaggatgagaaagcaaacctagactgtctctaatatcttacagcactgcagatcctacccctgcctttttttttccagcctccatctgagagcctctttctgtttctggtaagggtatcttcacccgtcaccaccctggtgggctggcttttacgttgagtgctttggtgtgaaaagcaggcttcgttcaagttgacttcaactttcctctttaaccttttatcatgtgttcttgttcactctcttccttcatggtgtcaagtaaagccagtagggatgaatcaggttcactgttcttttggagatgtgaaatccatgaatggggctaggtttcattatgtctccctctgggtagacccaattccctcctaattgcctttttcctgttgatcattcacatcttctgccttggaatttctttgaagttttatcatgttctcccttcatcatgtccttccctttgtgacttcagattttctgtgggtagctgtaatttcctgcagaacagtgtctactagattccctctgagcatggctggtgcagtggtaggattctgtgaaacgttgtcagatgtgtgagtgtgcagattgataaaacagcgtacactccctgcttcgttcccacctctgttttatgtggatgatgacaattacagcacagcacctcatatcggtgcagagatttctcctgctgtgatctaatggtggtctgtgtgcatgtggactgggaaccagaaggtggctttttctaggagatcttggctgcaggcaagcctatttctgccaagctagggattgtccgggtcttgatagagctagctgttttgtaccattgttagtagccaggctgtaattctgacatttcaactacttggactctgaaaaggtgtggttgggccccagatcatcagccaagtcttccactcagcctgcttcatgacctgacatgcttagcatttgggcccctttccaagagtgaagtaacacactgatggggagacaagaaagtgaaatagtggccccttggttctcacggggaagaggggagatgtgttcaggcctccccttcctccgccttcattggtggttcctaggtgagaatcactgggaatcaggaggatctatcagaactgggaatcaggaggaaccttcagatgttgtgggcaaacaggggggcaaggggtgacgttaaaactaggctttgtcactttcaaaagtctgcattacagtcagccatggagaaaacggcctactttctacatcacaggcgtggcttaaagatataaggccaggccatttgaaaaggtttagtccctcgtagaaaggcatacaaatcacccctcctagtttgggttcccacagaggcaggattccagtgtacatagtttatgtgggagatgatcccaggaaacttgggaaggggagtggggaatgagaaggggaggaaggaagccaataaaggatgtgctatcaagctcgccatcactgtggacagctgcagctcagttccactgggaacgtctgggaaagagtgtagcacaggtgcctctgagtgatcacacctgagaggggaggttctgctggccagagaacctctggtaaggaggtgcaggggctggcagttggtcaggcccatgggcactgttacaatgaaggctgagggaaaacgggtggggcatcgattgctttgctgcaggtcccatcccggattcaccttcccagggatgctagatgggagtctagacattgtctctacagaggatgaatctggaattcagaaagatgatggaggcccactgtggagaagccggttcttgagagttgggtgagaatccaggcttcctgactcttgctgcagtgccctttccacttggctacttaaggcagaaatttaaatttgtgatgacttttgaggcatactgtacctgattcatggaacaatattgtccttcccaccatgggctctttagtctttcttggagtgaaaaattgtcaaaagattaaatcctatttgggagccagagaaaaagcaaaagaatggctgagcgtgtaaataaagtctcctaggaagatcatatttttgaaggtatttattattcatatctttttgtcattgtcgtgttgtaagtgtttacctgggcttctagctttttgcttttccaaggacactgctgatccatcctagaagaagctgacagccaccaccttgacactggcttattgctgtccaggttatttaagatgcggaggaaatcttatcacagagaagcagcttctaaacatgtcctgccaggtgggtgatgaggtaaagactgcccaggcggccttgtgcacaccacatacttgtggagccactttgatgaaagggtctggattatttgcaaagtcttgtgctaggtgaaggtgggctctttcttaaattctgaaatgcccacgagtctttggtaatgttcatagtgaagcatctgagctgagcctgaggcttcccaggaggctgtgccaaggacaaaacacactgaggatgttgaccatggcctcctgacagaatgaaaggcccccacagtttcaatttaaaccgtaaacatttaaatagaaaatgaagtgctggtgtatgactctgaacttgtgagactagctgaaaacaccattttgaccgttgggcagagatttcccatcatgggatcagccatagaccatatccactgggaacatggagaaaaggtttagaggttccaccaacattttccttaattcttagatgccttttggtggttgaattctgtccttattttcttatttcctgaagcccaaaatataagctctataatgtggtcattcataaacctttagggatattcctattggaaaatgttgtgcaagtcttattttagagttcccagaagggaattaccggaccttaagatatgcacgttttgaagatattggatacaactggtctccagaagtgggaagaccatttttgctccttttaatagtggtgtctggtgtctctttcctcagatattcagtaatggatatgtcatgctttttcattttgcccttctgataggtggaaaatgacgtaacatccttaatttaagttacattttttggatgccattgtgaattttttttcccctatagctattgcctatttgcataccctctgaagttgcccgttcttgaaggacactgataatgttctcctcccctgccctttcctttttgttgccagaataacctaatctaaaccagaaactccatcttttcttccccagggctcctatagacccataggcggctagagtgtacctgtgagcctctggggagatgtctcaccgccagagagctgtccccaactcaggacctcacctgcctgtgcgtgcgaaattacacctgagatggagtggctgtgtccagctaacaaagccgtttggggaggggatttcaagcatggctattccttgttcactttaataaaacatggcatgaattcaggcaaagggacttactccttactccctcacctcagatttttctgtgttttgctgttggtataacttgtcctgtgttgctaagttttaaacatatctatattttgtttaaaacactaaccatggctttgtttgagtggcttatttttatgtcctaaggagttgacctagacagggaacagttagtcatattctgtttcaggccaatgcctctgagccccttcccttctcgtttttctctgtctgaaatgatgctcttggctggccccattttgctgtttgtccaaacgggcgcccctcagcaatgggcaactttctccattttggtgtcttatctaagaccttgcccactggcttaaagagttggcttgggttccgtcacagtgatgagttgcctgtcccgccgtctgtagtcgggagggctttttccgtgatgagaatgagctgcaaactcaggcaaacactgatcaggagagacatgaaacccaacctggcccagtcggcttaaaaatagtccagtcatttcacccctggaattttctcttgcttatgtgggtggacaattctcttggaacaccaccaagatcatgaggaggagaaaacagagcaggcaccaaccacatgaatccaacccaggctgaccccgtagccggtggtgcattggccctcacaggtttgcaccctgcatgcagggccctttctcccccacgagagggcgctctcgtcactcttaaagcaatcgtactggggaacactcaggttgtttcttagtgaagtccccgaagagcactgcatttaagctgctactttgtgtctcagcttctactttcaaggtttgttatgaatgtaaagacattctccaactcaagcaagtgtgggcaatattagtgtctggaaacgcctgttgcaaatgaagcacagccactgcttgtttgtgtttcgttagtgaaacgtgattgtaacccagggtttttgacgctcacagaagcatccgccttggtaatgctgtacatccaggctgctcttctttgtccctaacctggttgcaatgtggccgtagcatgcttgtgttgacatctgacaggagatgaggacttgacttcctgggctgatcttgcttattttggggagagcaggagtgcccgtggttagtgtggatcagcctgacaggagattttctattgagggaggatttaagactgcatgcaggcaagggaaatacaagccatatttcaccagctcaatacaccagggagcgctaccatttaacgaaaaccaccattctgacttccgggtttttaggtcatctggcagccactgggtggggtcagtttcttggcccttgattagaagttccttctgattacaaaacacctcttgattgaaatctttgcattttctttgcatttgcatttccaccaatctttttattttttattttttttgccttggaggatgtgtgtatgtgagggtgaccttctctttatttgtgggaatcggggagtgccctcctccctacaaagtcactataaagctacgggctttgctgcccttggtacagggtctagaagtggttgttgggtggtgaccagcacagtgacagtttatttcctggacctttgaacctaaattcccacaggaagaacataaaggactcagcaaatcttgccccccgacccccgtctcctccatgcgcctacactggagccatgagtactactgctaccgtcactacagccaaattattatagagaattactatgtgccaggcatgggtaatttttggttgttttaatcaactttgtttcaaacagctttagatttgcagaaaaactatgaatatagcaagagttcccccactttctcctttttttatttattttattttatttttttgagacggagtctctgtcgtccaggctggagtgcggtggcgcaatctcggctcactgcaagctccgcctcccgggttcatgccattctcctgcctcagcctcccgaatagctgggacgacaggcgcccgccactacgcctggctaatttttttttttttttaatatttttagtagagacagggtttcaccgtgttagctaggatggtctcgatctcctgacctcgtgatccacctgccttggcctcccaaagtgctgggattacaggtgtgagccaccgcgcccggcctcctatttttaacatatagtttctcctgttgttgttgttttaatcatattagcataacacatttgttacaattagtgaaggaatattgatacattattattaactgaagccaatactttattcggatttcctttattttgacctagtgtcctttttctgctccgggagcctacccaggataccgccttaccttagttgtcatgtcttcttaagatcctgctggcggtagtggtttctcagactttaaacttgtttttaatgaccttgacagttttgaggagtactgctcaggagtttagtagaaggttcctcttttggaatttgtctaaggttttctaataattagactggggttatgggtttttgagaggaagaaggcagagagaaaatgccattcttatcacatcatattcagggtacatattattaacatgatttaacgttgtagatgttgaacgtcatcacctcgctgagacggtgtttgtcaggtttcttctcgtaaagttactgtcccctctcctttttttatactgtactatcacaagaaagtgaccacgtgtagtccacacttaaggagggggagttatattccaccctcagagagcacagtacctataaacatttttgaaatttctctgcacagaaaatttctctcttcttccccatttatttacgtattcaattgtttatttctatcaatatggactcatagagatttattccatactttgagttataatcaaatagtatactactagattttgtttggttttttttttgcctctgggagctgtttcacgtgactcctgtgtccctttgacacacccccatcattgcgggtttttgtttttgaggtgtttctttcttgctttctttgtggcactcactacaagatactccaggattatcttgtacatcttctgccctagtccttgaatcagtcatttctccaaaaagccctggccttttttttgagacggagtctcgctctctcgcccaggctggagtacagtggcgcgatcttggctcactgcaagctccgcctcccgggttcacgccattctcctgcctcagcctcccaagtagctgggactacaggcgcccgccaccacgcccggctaattttttgtctttttagtacagacggggtttcaccgtgttagccaggatggtctcaatcttctgacctcgtgatctgcccgccttggcctcccaaagtgctgggattacaggtgtaagccacggcgcccagccagccctggctccttttattggagggtggtattagaatagggtctgggctccaggtgtgctggtgcttctggttgctgctgctttataagctctcagctgacagcaagaaaacatgtgcatgtgaaccaatctatagatgcctatctactgatctacaaatatatctgtatgtaaccattggtatctgtattatgctaaacatgtgttcacactgacgtttccagctcttaagctgttacatgtctccagctctaagccattatcacgtggatcattctagccttcccccttgcctatctgtagcctcctactccaaaaatgataaacttggctctcagcatctgtcatgcatttatttagttgttcaattccagtatacatatgtagcagtatcaaaattgttaacttatacccccatggaaaatagcctcgtcaactagagtacagtgcttgtgtacggtttattttgccttagttttacagactgcatacatttccaaagccacttaaatagcacctttttcttccatccactttagtgagggttgttcacatatgtaccacagattgctttgtcacatgctgtatttcattccgggattaccctgactgcctaaatgatttttttaaagtttatatatgttaagatttgccctttgtgctgtaaatttcaatgggttttcacaaatgcataatattatgtacccaccattacagtaatgtacagaataactataccaccctaaaaattcatctattcacccatttaactatcctccatacctggaaaccatggattttaaaaaactatctacagttttgccttttccagaatgccatataattgtaataatataggatatgctattatgtctccactttccacttgaggactctgaccttagaactcatgattgcccacggtttcttggcttgtaattggtgatgctagcgtcaacccaagtctctgatgttaaaacaggaactctgaaactccccactatgctgcctattttccaatgaaatgggtccaggaagccatctgataaatattttcactaggttgtcaaaaattaataaacatgcctctttcattaccttcggaggccatctgtggggtggttgtgagtcagcctctgcagccatgctgccagaatttgaatcctacctccttcacttcttacccatgtgatttgaacaggtggttttactttttttttctgtctttcctggcttactaaacaattcttcctttttaggaatatatgggaggagggatctgtgcaatgcagttctacaccctggacatagcaaccgactgagtcaggccaattaacttctctagcctagcgatttgaaacccagagccggggccctctgacatgaaggcacctttatatcttcagtctgtagggcaggtcataacacctgcagccacagttcctggggtggccccaagtctggatgcttagggatttattaattttttgagcaactccagtatcttaaaaagaattcatccttctcttccttttgttgttgttcttcttttattcttatttttaaaatttaagcgaggtaaaatcagcccctcttggctacaggtactttaattactacaggagatcatagtagctacctcactggtcataagggttaaataagataatgtataagacagttagcacagggaatgagggaattgtcagggaataagtacctggtaattagtagcttttactattatctaataatagttcttgatatttacttagtgctttgtaatgtgaaccatacactcctgtgtgcttatctccttgacaattgggtggaaatggcatccacattttatggatgagcaaatggccatgctttggggtttgcccagggtcacaaagctggcaagggactgagccaggatccccactcaggcccttcgtcatgtcatgtatccagggttctctccaatgtgccagggtcgtgtggtttcctgggggtgtgatggagagggaggcagtttccctttcccattttagggacaagagtggagatgggaaagtactttcctggggacagaggatggaggtgaaggtggtggatttctttagttatggggagttaagttgggaatgttaggcctctagtcctttccttttctcttttcttttctttttttgagacagagtcttgctctgtcagccaggctggagtgcagtggcacgatcttggctcaccacaatctctgcctcccaggttcaagagattctcatgcctcagcctcccaagtggctggaattacaggcatatgtcactggctaattttttgtatttttagtagagacagagtttcaccatgttgaccaggctggtctcgaactcctagcctcaagtgatctgcctgcctcggctttccaaagtgctgttgttacaggcatgagccaccgcacccggtctgggccctgagtcagtttctgacctgccttctgagctctgcatggtgcctggggtcagcctgcttctggcttcaccactctctgttctactgcatttattgtgcaaacagttgattgaatgcctgtttatgtgccaaacactgtgttagggaagatgaaaggatagatgagacccattaaggtctgccctttaaaagcttgtaatatgttggagaaaccagacatgaaaacaactaagtataacacaacataatgtctgaaagataaaaacaagtgttttcagaacacaataattcacagaatacctacacatgccataaactgtgctaagggttttccatggattagctaatttaatttccccatcaaccctacaaaggaattactgtggttgttctcatttcacagatggggaaactaagcacagagatgttaaatcacttgctcaatctttataaagataggaattgtagagttaagttccagagcctgccctgttaatgatggcactaaactgccttccagagaaggtcagaatgcatagctctttgtaggattgttggtgaaacttgcagagaaggtattttctgaactgatattcaaggatgagtaggaatttataggtggatagaaaaggaattgtattccaagtagaggaaggaatgtgagtggacacacagatggatgaaaatatataatgtgttcagggaatggctagtaatcccagaggtcaagagtggcaggcagtggttggctattacacttaaaaggttaaagctaatgccgtaagcattggggagctctcagaggattttaagaaggggagtctgtgtctagatacacttcaaaagggttcctgtagtagcagtgtgaaggctggtttgggcatgtgtcagaatcatttgaaagccaggagggcctgctggaaggcctcgcaatagtctaggtgagatcatgcatcggctttgggatgtggcagtagaagtgctggcttcttgtggttttgggggttggtgcttcacagagtgaagaaagaggtgtcacaagggtcattaaaatcccactggtgtgcctgttgatataggaggcacccatcttactctctaacggtgttctacaaactagccaggctgtgaactgttcattactgtttgggccaaaataaggggcttgcaccagaatataaatcaatgcattgcttccatcacggagaaaatcttggtgcacacacacacacagtctactgaagcaaaaagtgtgcttagtgacaaagttgatttggattctagtgcaagctcttatttccttgcagcccacaaacaacatgtggactttcaccagtccacaaccataaatagagtaatgctgctgtataatcaacatatcttacttgctctatacttcaaatatcttcttctctacagctgaattttgtagatgaaaaatttattttaaagtttcaacattttaagaggtttctttttactctacaggcaagccacttatgtaaaggacccatcttttaatttttgagttttggaaacttacatgagtacttaaccttgattaataattgataactctttctgtagagatgggccggtgacctcttgctactctccagcattgttaagtgctattgcctttcagacttcagattctttccaacctctaacacttgggccattattccttctccaaggttctcagaagtgatagagcactggagaggcaatgaaatcaatgatttctctatcacttgagtgtaaagtgtaaactaaattatcacttagcagccatgttattaaagggattcaaacattggtaaagtgtctggactaacagactttcaagattctttgcaaccccgaggttttcgatttgtcggaggtacagaactggtaagcggcagagagcggcagcacctaggtttcctgacccttgctgcttgcttccctgccgctcccctcagtccttcatcaagagctgcagaacaagttccactctccctggaggataggtgctgtgggtcttcatttaatggtgggacctctggagatttttctctctgctaatcacccaaggatgctttacatactctactgagatctaaatttatattgcagatgggccgatgctgatgtcttaaagtacttgctgggaagataatacccaatctctggagaaaagagctttacatttctttttactgagggctgttctgtaatttggctctcctaactctggcttgccccaacaatgagctacgtaattggccttaaagggacacccattgatttggacagggtctgtacatacaccagttaaacacagtgcctcatgctgggtctgtgtatttctactgggctttcttttctaaatgttatttaattccagagtttgcattagtgcttcagtcaaatattgtcaggctttggtcaaaaacccttaactgaagatcagggttggtcataaaaagttggaaatcgacatttgccaatgccaattggcagacagttggcactcaaattggggacagggccaggcaaaaaaaggtcttcaaaaactgtgctccaaaatcctctaaaatccactgtggttgcatcattgcccaaacttacagcttaatatgttggctttgctgcttaacagctgtgtgaatgggcatgttacttaacctctgtatttctccatcataagatagacataataaatttaaacccatgggttattgtgagaataaataagataatccatgtaaaagatgctcagcctagtccctggcatatggcaggtactcaagaaatgtttaatttgaatctgttgcatgcgcattctccgttgtagccagataagtctctctgcaccatgaaatgccattctatccctgcctttatgcttttgtttatgagcagaaggaaagtatgacctaatgattaataacatggcctttgctgtcaggcacacctggctgaagttttgttttctctgttgcaggacgcgggtgagttaattagctattttaagccccagtttcttcaccgtataatgggggaataatggtactgaccttacagtgttgtagtgagggtttaaatgagataaaatttgtggatgcctggttaagacaatcatgagccagcttattgagctcctattatgagttggtcctggaggtagagtggtgagcacacccagctgggtctaatggatgtataaccataaacagttacaagccttaaagtaaatatttacaaataattacaaaggggcaatgtatgtaagtgccaggtgagcagttagcaagggggcccagctaggtctaggggtcacataaaacttctcagttaccttgaataccatacaggatgtagtattaaaggttgacgtgaaggacaaagaggaggtgaccaggcccagagctggggaaagactgtccaaggcaggggaatagcatgtgtgtggactcagagaccggagagcatgcgctctgttttgaagagctgagaaaagtcctgcgtgggtcttgtaggtgttcaatcaatggcaactgtcattattctagattccctctcagggtgctgaatcctaaagcagcttgagtgcctaccttaagtctttttctctttttaatgaagcttcctttgactaactcagaactgattccaatctactctaaaaccttatagtattttagtcagtgctatatagatcaacacttagttatatgattttaaaagttgttcttgaagttttatgtatctttcctgagtcatcaaattgattgaaaattcactgaagagccctgattttgtattatgagtctccagagggcttagcacaatgctgagtccacagtgattaacaaatatgtaatgcttgttgcagaaatatatcttccacctaaaattctgtagtgtaccctgggcagtgttgggagggtgtacacttgggacccagattcgacaacttaaccattttctatgtgtataatcttgggcaagtcattctttttaagcctcagttaccttgaataaaaaatgaggatagtaccatagttcatttactgtaagactcattttcttttcttcacattttaacatctctaaaacttgaatgtgtcttacaataaatggcatgttatagtttaattggcagtattttttttctgtgttggtgattataaaataatggtgtgtcttaaattcagtgacattttaggtttgatgaaataaatacaacttttacattttaggatggttatgaaaattcaagctaatttacacaattcatttgtccacaattcatttacctgatgttggcatgacagtgaagaggtagctgcagacaatcaaaatcattcctgtgatccagtacaagctttgctaactgccaaagttaaaaactgttacggccgacatgcatgccagaactcaaaagccacctacctttagcctcaattcctccagatgtattttgctacttttacacattgttaagttttgtggcataatgcttaagatgttggatttgttgaggagttcccaccctcctaccctagttctaagccaattgagaaataaggtgaaaaaccaacagatgaagaatcaaaatgtcactaaattctagattgtagtgtgtagcttatatctatggttaagtgggctctgtgatactgagccccagaattacctgtgcatttagggatatgctgataggctgctgctgtgagggtgcaaaggagaatgaggatttctgtgggcagcccattccaaggagagagggaaagagctgggagctagactatacatgtcactcacagatcatgtaagtcagtcttcaggccagtaaagaaactccaatagggccctgcccaactaaagggaacttctggggtggggcagcacctggcatagagtaggcttttagtagatggtagctattagggaaaatcatggcagcttttgagaagaaaaagaagttatcccaaccttcaaaaatactctgttttttacattatgtaccccttaagcagacctttaagggcatgtatgtttgtctaggattcctaagcattattttcattaaatattgttagtccagtgattacttggttggttatgcagttctcaaatcaggtggattttaaaacattaatatctcagcaatctttaaatacactattcaaattatgtacttacagtaagtccataataatagggtgttgcaaacacaggaattgctatcataatcttaaagataaaaataatttgagtaaataaattaggaaggggaaaggctgatgttagtcaatgccaaagctgattttgtagagccagaatgaaaaaaaatatgtgattgaaaaatgtaggcatctatctgcaagactttctaaaaaaaatgcagatagtagtaataaactgcattgctggagagaggggactaaaatgtgtgtgtgtgtttttaagatttaacttttaagttcaggggtacatgtgcatatttgctatataggtaaacttgtctcaagggggtttgttgtacagattatttcatcacccaggtattaagcctagtattatataggtaaacttgtgtcatggggtttgttgtacagattgttttgttgaccaggtattaagcctagtacctgttagttattgttcctgatcctctccctcctctcaccttccttcctctgataggccccagtgtatgttgttcccttctgtgtgtctgtgtgttctcatcatttagctcctatttgtaagtgagagcttgcagtatttggttttctattactgccttagtttgctaaggataatggccttcagcttcattcatgtccctgtaaaagatatgatcttgttccttttaatggttgcatagtattccgtggtatatatgtaccatgttttctttatccagtctatcattgatgagcatttaggttgattcaatgtctttacaagtgtgaacagtgctgtaattaacatacatgtgcatgtgtcttttataatagaatgatttgtatttatttggatatatacccagtaatgagattactaggtcaaatggtatttctgtttttaggtctttgaggagtcaccagtgtcttccacagtggttgaactaatttacactcccaccaacagtgtataaccattcctttttctccacaacttcaccagcatctgttatttttgactttttaataatagacattctgactggcgtgagatggcatctcattgtggttttgatttgcatttctcaaataatcagtgatgctgagttttttttcatatgattattggctgcatgtacatcttcttttgaaaagtgtctgttcatgtcctttgtccactttctaatgggttttttttcttgtacatttgtttgtatttcttataaatgctagatattagacctttgtcagatgcatagtttgcacaaatttcctcccattctgtaggttgtctgttcactttgttgagagtttcttttgctgtgcagaagatctttagtttaattagatcctgtttgtaaacttttgcttttcttgtaattgcttttggtgtcttcgtcatgaaatctttccctgtttctatggccagaatggtgttgcctaagttggagtttttctagttttgggttttacatttaagtccttaattcatcttgagttaatttttgtatatggcggaaggaaggggtccagtttaagtattctgcttgtggctagccaattatcccagaacaacttactgaatagggaatcctttccccattgcttgtttttgtcatgttgaatatcagatagttgtaggtgtatggccttatttctgggttctccagtctttttgattggtctgttttctctttttgtaccagtactatgctgtttggttactgtagctgtgtagtacagtttgaagtccagtagcatgatgtgtccagctttgttcattttgcttaagattgccttgactatttgggctcattttttgcttccatatgaattttaaaattgttttctctagttctgtgaagaatgtcaatgctagtttaacaggaatagcattgaatctataaaatactttgggcagcatggccattttaacaatatcgattcttcctatccatgagcatggaatgtttttccatttatttgtgttatctctggtttctttgagcagtgttttgtagttctccttgtagagatctttcacctccctggttggctgagtattcttaagtattttattatttttatggcaattgtgagtaggattgcgttgcctattcggctcttggcttcactgttgttgatgtacaggaatgttagtgatttttgtgcatttattttgtaacctgagactttgctgaagttgtttatcagcttaaggagcttttgggctgagactattgggttttatagatataggatcatcttgtctacaaacagggatagtttgacttcctctcttccgattttgatgcccttttcttctttctcttgcctgattgatctggccaggacccaatactgttgaataagagtggtgagagagggcatccttgtcttgtgctggttttcaagggaaatgcttccagcttttacccattcattatggtgttggctgtgggtttgtcatagatggttcttattattttgaggtatattcatttaatacctagtttatcgagagtttttaacatgaagggatgttgaattttatggagagccttttctgcatctattgaaataatcatgttttttgtctttagttctgtttatatgatggctcacattaattgatttgcatgtgttgaaccaaccttgcatcccagggataacaagcctatttgattgtggtagataaattttttgatgtgctgctggatttggtttgtcagtattttgtagttgatattcatccaggctattggcctgaagattccttttgttgttgttgtgtgtctgccaggttttggtatcagcatgatgctggcctcatagaatgagtaagggaggagtcactctacctcaacttttgggaattggttcagaaggaatggtaccagctcatctatgtacatctggtggaattcagctgtgaatccatctggccctgggcttttattggttggtaggctatttgttgattcaatttcggagctcattattgtctgttcagggattcagtttcttcctggttcagtcttgggagggtgtatatgtccagaaatgtatcaatttcttctagattttctagtttatgtgcatagaggtgatcataatattctctgatggttggttgtatttctgtggggtcagtggtaatattccccttgccatttctgattgtgtttattggaatcttctctcttttcttctttattagtttagctagtggtatgtctgttttattaatttttatcaaaaaacagctcctggattcattggtcttttgaatgatttttcatgtctcaattttcttctgctcagctctgattttggttatttcttgtcttctgctagctttgggattgtttgctctagattctctagttctttagttgtgatgttaggttgttaacttgagatctttctaattttttgatgtagtcatttagtgctataaatttccttcttaatactgccttagttgtgtctcagggattatgctacattgtatctttgctctcattagtttcaaagaacttcttgatttctgccttaattaatttttttacctcaaagccatttaggaacaagttattcaattttcatgtaattgtatggttttgagtgaatttcttagtcttgatttctaatttgattgtgctgtggtctgagagattgttatgatttcagttcttttgcatttgctgaggagtgttttatttctgattatgtgatcaattttagagtaagtgccatatggcaatgaaaattgtttttgtgtggagagttctgtagatgtctatcagatccatttgatctaatgctgagttctggtcctgaatatctttgttaattttctctctcactggtctgtctaatattgtcattgggtgttaaagtctcccactattattgtgtgggagtctaagtctctttgaaagtctctaataacttgctttacgaatctgagtgttcctgtgttgggtgtatatctatttaggatagttagatcttcttgttgaattgaaccctttatcatatgtaatgcccttctttgtctttttatctttgttggtttaaagtctgttttgtctgaaactgagattgcaactcttgcttttttctgcttggtagatttttctccatccctttattttgagcctatgtgtgtcattgcataagagatggtctcttgaggacagcatatcaatgagtcttggttttctaatccagcttgccactcagtgtcttttacctggggcacttagcccatttacctttaaggttaatattgatatgtgaggatttgacactgtcaccataatgttaactggttattttgcagacttgtttatgtgattgttttatagtgtgactggtctatgtacctcagtgtgtttttgtagtgctggtaatgctttcctttccatatttagcgtttccttcatgagctgttgtaaggtaggtctggtggtaatgtattccctcagcatttgcttgtttgtaaaagattatttctcctttgcttatgaagcttagttaggctggatataaaattctgggttggaatttcttttctttaagaatgttgaatattgacccccaatctcttttggcttgtagagtttctgctgagaggtctgctgttagtctgatgggcttccctttgtaggtggcctgacctttctctctagctacctttaacatttttcctttcatttcaaccttggagaatctgatgattatgtgcttggggatgatctttagtattagtaaaaagaattttactggggttctctgcattttctgaatttgaatgttgccctctctagctaggttgaggaagttctcatgcatgatgtcctgaaatatgatttccagattggttgcattttccccatctctttcagggacatgaatatgtcatagatttggtctctttacataatcccatatttctcagacattttgttcattcattttcattatttttctctattcttgtctaactgtcttatttcggaaagccagtcgtcaagctctgagattattttcttcacttggtctattctgctattaatacttgtgtttgcattatgaaattcttgtagtgtgtttttcagctctgtcaggttggttactttttaaaatatatatatatactggctgttttgtctgtcagctcctgcattattttatcatgatttggagaggtgatgcagtcatttggaggaatgaaagcacactgactttttgaattttcagggttcttgcactgacttcttctcatctttgtgggtttatctaccttcaatctttgaggttgctgaccttcagattttttttttatcctatttgattatcttgagggcttgattttggtataaggtggattcaactgactagcttcatttctggaagattttagagggccaacattcagctcccaactcctgcactgtgtactctaactctgggggacttctattgggccccagctttgttctttggctccccaaggttaggaatccactgcggtgaaggggcctgaggtgtggcagctgtggcagagtgctagcaggtgtcggggtgcctgcctccatgtgggtgttcaccacagtggcagaaacaatgcagctgttgggggagctcctgctggcaactatatgtatggttgtgctggacatggtgttggcttgggggtggggtgctggcagatgcaggcctgggtgccttctctgtgccccataagcaggagtgattggtcagcatgggggaggactgttgttctctgcaaaaatgtttaaaaaagaaattgtttcaaaaatctatataaagctttggattctgtaaatccaaaattcattactggtttattactttactggccagggattatggcaccagaagagagatctgtggttctgacaataagccatgaatgtggtttgcccagtacatggtttagctttgtttctgtatcagacacgctagtttaatttacaaatggagttttgatatactcaggactgtgaataagtattggggggtggtgtctggtgaaaggcagacaaaccacagtagctcatttccttttattgatccgagcacaaagcattgttgttgcatcttagaaattaaaatcctcatttacagaatagtgtggtgcaatctggaaagatgttgttgtggtctctcaggagtgaataatatgagtttttaaacattttccaagaaaaatttacatgatttcaaacattctaaagcataaggatgtacagtatttcttacagtagaggaaactgccaaatattttggaaaaatataagaaaggaactgtacattggtaagaatgcattttcaaagactatttattttgtttgtttttaactgaacagttattcattgagaggggtgtgtgtgtgtgtgtgtgtgtgtgtgtgtgtgctgaagatagtattatcccaaataatcatattatatagaggctacaactcagtcttgcaaactgctcttacttgcaactgacagctacctcccacaccctcttggcatttctctagtgaagctattgatgtaattattgcttttagggttctgtattaaatttaaaaaacaacttcttttaattttgtgcttaatacagaaatcctaaaaaatcatagaaaaacacaaaggaaaaaaatccagcattaaccactaactaagtggataactaagatcagagaagaaactaaaacaagtaactaataactaagatcagggaagaattgatggtgatagagacgtgaaaaatcctccaaaaaaatcaatgaatccaggagctgttttttttttgaaaaaattaacgaatagatagaccattagctagactaataaggaagaagagggagaagaatcaaatagacacaataaaaaatgataaaggggatatcaccactgaccccacagaaatacaaactgccatcagagaatactataaacaactcgatgcaaataaactagaaaatttagaagaaatggataaattcctggacacatacaccctaccaagactaaaccaggaaaaagccgaatccctgaatagaccaataacaagctctgaaattgaggcagtaattaatagcctaccaaaacaacaacaaaaaaaaaaaaaacaagaaaaaaaacacagaaaaacaaaacaggaccagacagattcacagattcacagctgaattctaccagaaatacaaagaggaactagtcccattccttctgaaactattccaaacagttgaaaaggagggactcctccctaactcattttatgaagccagtgtcatcctgataccaaaactgggaagagacacaacaaaaaaagaaaactacaggccaataagccaaataaacattgatacaaaaaccctccataaaatactggcaaaccaaatccagcagcacataaaaaaaaaacttatccaccacgatcaagttggctttatcgctgggatgcaaggctggttgaacatacgtaaatcaataaacgtaatccatcacataaacagaaccaaagacaaaaaccacatgattatctcaacagatgcagaaaagacctttgataaaattcaacattcttcatgttaaaaactctcaataaactaggtgttgatggaatatatctcaaaataataagagctatttatgacaaacccacagacaatatcatattgaatgggcaaaagctggaagcattccctttgaaaaccagtacaagaccaggatgtcctctctcaccactcctgttcaccatagtattggaagttctggccagagcaatcaggcaagagaaagaaataaaggtattcaaataggaagaaaggaagtgaaattgtctctatttacagatgacaagattttatatttaaaaaccccatcacctcagcccaaaaacttcttgaactgaaaagcaacttcagcaaagtctcaggatacaaaattaatgtgcaaaaatcacaagtattcctttacaccaacaataggcaagcagagagccaaatcatgaatgaactcccatttgcaattgttacaaagagaataaaatacctaggaatacaactaacaagggatgtgaagacctcttcaaggagaactacaaaccactactcaacgaaataagagaggacacaaacgaatggaaaaacattccatcctcgtggataggaagaattaatatcatgaaaatggtcatactgcccaaagtaatttacagattcaatgctattcctatcaaactaccattgatattcttcacataattagaaaaatcgattttaaatttcatgtggaatcaaagaagaccccatatagccaagacaaccctaagcaaaaagaacaaagctggaggcatcatgccacctgacttcaaattatactacaaggctacagtaaccaaaacagcatggtactggtaccaaaacagacatactgactaatggagcagagtagagacctcagaaataacaccacacatctacaaccatctgatctttgacaaacctgataaaaataagcaatgggaaagaatctcctattcagtaaatggtgctgggaaaactggctagccatatgcagaaaactgaagctggaccccttccttacaccttatacaaaaattcactcaagatggattaaatacttaaatgtaaaactcaaaaccataaaaaccctagaagaaaacctaggcagtactattcaggacataggcatgggcaaagacttcatgactaaaatgccaaaagcaattgcaagaaaagccaaaattgacaaatggaatctaattaaactaaagagcttctgcacagcaaaagaaactattatcagagtgaacaggcaacctacagaatggtagaacatttttgcagtttacccatctgacaaaggtctaatatccagaatctacaaggaacttagacatatttacaagaaagaaacaaacaactccatcaaaaagtaggcaaaggatatgaacagacacttttcaaaagaagacatttatgtggccaacaaacatacgaagaaaagctcaacatcactgatcattagagaaatgcaaatcaaaaccacaatgagataccatctcatgccagtcagaatggctattattaaaaagccaggaaacaatagatgctggtgaggctgtggagaaataggaagacttttacactgttggtgggaatgtaaattagttcaaccattgtggaagacagtgtggtgattcctcaatgatctagaaccagaaataccatttgacccagcaatcccattactgggtatatacccagagaaatataaatcattctactacaaagatacatgcacatgtatgtttcctacagcactatttacgatagcaaagacatggaaccaacccaaatgcccgtcaatgatagaatggataaagaaaatgtggtacatatacaccatggaatactatgcagccataaaaagaaatgagattatgtcctttgcaggaacatcatcctcaacaaactaacacaggaacagaaaatcaaataccacatgttctcactcataagtgggagctgaacattgtgaatacgtggacacagagagtggaacaatgtgcactaaggcttgttgtgggatgggggtgagaggagggaacttacaggataggtcaatagttgcagcaaactactatggcacacgtatacctaggtaacaaacctgcacattctgcacatgtatctcattgttttttttttttagaagaaataaaaaaatttcagtgttaatgactgtttacattttcgtgaattctttccaatatttgatatttatacatatataataaaattatatctacctacctatctgtctacctatctatctgctttctagtctccctttttcttttacttagctcagatcatgaagatttttttccatgtcaataaatatatttcttctcttttctttttcttttcttttttttttttcttttttttgagatggagtctctctctgttgcccaggctggagtgcagtggtgcagtctcagctcactgcaacctccacctcctgggttcaagcgattctcctgcctcagcctcccaagtagctgggatcacaggtgcccgccaccatacctggctaattttttgtatttttagtagatacaaggtttctccatgttggccaggctagtcttgaacacctgacctcaagtgatccatctgcctcagccttccaaagtgctgggattacaggcatgaccaactgcactcagcccaataaatatgttctataatacgctacttaatgatacctattacattatattgtatggaagttccattacttacttaatctgttcttcctggacatctgatttttctttattgtaaaatgtgacatcttaaacatctttacatattcatcttcttccacgtctttgattacatcctttgtatagctcttagtagtgtttttgctgggtcaatgtttttgtaaataaaaaaaaaatgttaaagactttagacatgtataaccaaagtgccccagcaagagattgtaatccgcttacactgcctccaggagttttttgggagtacttgttttttcctaccctctcccaccagataatatgattctttttaccatttttaacccattggataggaatatattttcatgtttttatttgcatttctttggatttttgaggctacgtattacaaagctgttattttaaggcataccagagaacatgaaatcttattttatccatattttggttttatccatttgctttgaaccccctgaatcagctgccctgatggatagtttttttttttttggtgtgggcttggccatgatggggaacttggttgaaagatgagtgaagttaaggcagttcaaggatgtcatactttttagaagtaccagacaatcagaaaaaagtacagaataggagaaacaaagaaatcaaatacttaaaaaatatattcccccaggtcaatgctttgccatgaaaaggagaaaaaacagttctttctctctaagctgcagtaccccttggtcactgttccaaagcttggggcagaccatttgtcctatactatggctacatgtggatgaagtcatttttgtgtggtcttttaagactgaaggtactaatcacaattttaacattgcttctccagaaaaatactttctgagttacgaactttggggacacaaacctattggtcatttggagatctagtttcccttttatttttctaaattaaacattaaacaagacaatctgagctttgcctttttttcttttgggtaacttgatttcccaattataaataatgattatttaatgtctgttaattctttcacagtttagggtgaattctaattagccatctccctaagatatgtggtttgtggcttgaaaagttttctaatgccttccctccctagaactaatgactcagaactgagaaagactgacacagagcttcatcttctgctggggctgcaaatgctctggagattgcccacgccctcttgcagccactgctagatgaagatgaaagcccactgcccagacggcatcagtatttcacctgctcagtattgcacagaaaagtcttggtttgacttacagcctgctcattgctggaaggtcacagcactgttttttgatggagttttgagtagtcattttttctagtgctttaaacagattaaaatgtggttttatgggtagtcatttcctagatgcttgtgaaaacaattctaatcctaattgatggtagaaactgattcggagactcagtaaagaaagacatctgtgacgttcagttcaaaatagttaattattgattgatcacccaccagcattagcttatagatacacctgaggattaaacatgactttctggaacaaaataacttttttttttcctaaacataatgtacaagctgagcttaaatgagtgaaattataaaaggagataatctcaattttgccctatataagaataaaatatcagtcaaaatatttaaagaacagagatttctgtttggtgcaattttctggttaagaggttaatggaggggaatggaaagttattgttttatggatgcagaattttagttttataaaagagttctggaggtagatggtggtaatgattgcataacaatgtgaatatatttaataccatttagctgcacatttaaaactggttaatgcctggtgcagtggcttgagcctgaaatcccagctcctcaggaggctgtggtgggagaatcacttgagcccaggagttcgagacaacagtgagctctgattgtgctactgaactctagcttaggcaacagagtaagacgttgtctattaacaaaaagtaagaagaaaagaaggttaagatagtaatttttatgttatgtgtattttactacaatttttttttaaaaaagagttaaattggaaacaaaagtcttttaagagccttttggtctgagctttgacttaataaatacaatattaaatgaaattgtgcatttactaaatatttgagggacattattctggaagccaggtctcattttctaggactggagaagacagaatgtgttttggactcaggatgtgtttgtgaaagagcttaaaatttctttaggtgattgtgcattcctgtgatatgcattttctccaaaatgtacagaaagaaaaataatttgaaccctaattaattgggttctaattggtctgtgttttaggctctaaaggatcttagatcctttagatctttattaaatactggtaattcagtatttaattgtaactgatttttatgcaactgcgcaggagaagaagtgttcaggtgcagctttcttcccatccgtgccttccctaggccattgtgctttgtgttcttaagactcggtgaatgtttctgaaggtcagctagagtgcagaggagaattaatattaaaatgcatttaataaataagctgtcagatgattcccgaagataccataagcagcagaaagtcttctttcctctttcattcagatcgctgtgtacagagggaatgatggttaatatagtctctgttggcatctcctaacgggctttggtaatcatttctagcccagccgtgctccacggatttcatcactcttgagtgacggggccattttctcacagaatatggaccctccctgaaaaagagggagcagaaatagtcatctagcagtgtaacagttagggaatagaaagaaaatgacggattttgcagagaaggtctgcagaaactgatccagcatccctggcagtttgagtagagaatgggattttggtctttactttgaattgtcataattatttaatgtcaaacctatggagtgttatgaggctgtaagattttgaactctgtgcccttcagaggctctgcctcaggacacaaacacaggaagattaaacattaattaaagtaaccacacaggagaataaacaatgtaaagaagtagaaaaagacctggcttccccaccagggtaagccattttagaaagagagattttgtattgaacttacgagatggatgaaataggcttcactagacccaagggcatggagtaatttctcaggaaagtattctgccattgattcctggaagaaaaattagaaaaactcagtggatgatggaccaacccagaggccctaatggtacagagagaaaggaaacatgaccatgttcaagttacaagttgtagctgaccttgatgtttatcgccagaccgtgggaggttttggaatctgactgatgtctttcttccctgtagattgttattcagtgcctcggatgtgggcctaggaacctgtatttttaaaagattatctgatgtacagccgggtatgaaaactactgatcaagatcaatagttttaattaaagtcagggtggagggagtaggagggagggaaagacagagggagaaagagggacaatgaatgagctttggattcctttgttcaaatatgatcatctgagaaagagaaattctgaactgtcagtcggttcagagcagagctctgctggctgaattggatgtgggagatttttcttaggttcccagggccacagaaaggaagcccatgctgaataatccagatttaagccttacccattggccttggatgcctatttctgtcttccttgtctactactgtcactgtcaaccccttgtggctgttccatccccatgtgtcagctctttgtgggctggtttgcccccggaactattgctctgagttcttctgtccattccctgctcggctcagtgggctcctgagttagcctttagcatgtcacctttctggcatctccatggtaccagaacctttacttttcacgtgggctccaaccagcagcagctcccaactaggagtgtcccagcctggtggaaaggactggacacacaagatgggtcggaattgaatattaaatgaatttcaatacttggtgtacctttgtgaagtagcacattgattttgagagagcattgactttaaatctgatagatttttttgcaagcttcttttcagcaaatggcttactgtccttccatttgctgaggtcaaactccttggagtcattcttaattcctttctgtttttcacaccccatgttaaaatagtgaatcccttaacatatgtaaagaagccatctctttcccccacctccattgtcaacatctgggtctgtgtcaccaccatgtgtggcctggattattgccacagtctactaatttgtctaccagtttctgcccttgttccttgagtcttttcctaacatagtcatgtaatgatcctttaaagatatgactcaggttcctcccttttactcagaactcctgtctcttagagtgaaaaccaaagactttatagtgtcctacaaaaccctccatgacatggtgtttcccatcaggatctaccttgatcttagccaaaagcccaagaagcgatcttatcctgatctcacctcatctccaacttatttgcccttcagtcactctgctctggccataatttcctcctttactcacttggccaagcatgctgctgcctctgggcccctccctcatttcctctggctgaaagatgtttttgtaagttaggtatttgtatggttccctcacttttcttcaagtctgaccaattttgccttattagagtcagtttcagacctgcctatattaaaatggaacccctttgttaatttcatatactgttttccccttaccatgctttacttttcttcactgcacatttcatcatctgacattccactaatttattttattggtttattatttataaagtgctaacaaatactttaatccaaactctttgggggcagggcccacattttgtttactgcagatccccagtgtttaaaaagaacctagcacatactaggtgttcagaaagtatttcttaaacaaatgtattattagtaaatctgagttttaaatatagttttgtcacttcttaattatgtgacactcagtaagttacttctcagattcaagttttctaatgttaaaaataaaggtaacttccgtttcatggagttgtttttcagagtagaactaacgtttaatcttcccaactaaagtgtgagatcaaatttgcactaaaaatatgttattattattgctgttgatgccgacgggagacagggaaatactgggtggaagagggcggttcccttacaaaggctccaccctcaagcctggatatccctgtccccaagtgagaacagacattcctgttttcatgcacaaaatgttgccttttagcccaccatgccccctatcctatacccatataaaccctgaaccccagactccagaagcagatgaggagacgaacagatgagaagacgagcagatgagcagacaaatggcagaatgttgcagcagagaaggagagaagagaaagagcgcctgaatgtcagcaggagtttgtctggagatggtcagaaaatcaggtgctggatggccaaactccaggggaagatcatcttcccattccatctcctgtctagctccccatccatcctgctcagagccacctccaccacccagtaaaaccccacatgcaccatccttcaagtctgtgtgtgacccggttcttccaggatgctggacaagagctcaggatatgaaaggtgtcacgctggccctctgcccttgcaaaaaggcagagggtccactgagccagttgacacttaagccatgcgtggatggcaaggctaaaagaacacactgtaacatacacccaactgggctccgggagtcacaggctcccatccctggacgctgctgtggggccagagcccagcatcccaacccctgcacctgtccgtctgcatgctcccactcctgtaaggggtttgagcgatggtggtgactgaacagacaagccaaacccctgttgcaggtcctgtgagagtcagggaacccccctgtttcaccgttgttaatattgatagagctttaagactgaatttattcagacatggatagaatttcaatggaagtggaatccaggaactggctttaatcctgtgtgacttttctagaaagaaagtcttgattgcctctattttacttctaaaaaagtgtaggctacctgctaatggctcccagatttctgcttgaatgatctttgaataagtaaagacgttttggatgtaaattttcccattgttcttaagcaagtcattaaaattaaatataactatgaatggagagtgttttattctttcaattacatagggtttgtgaagagtcattctttgtctacttatatttaatcaacatgcaatattttatgtgccttattaccatgtgttaagaaggtaatattcacgttacctagctattttttacattagccaaaaaaatatggttatgtgcaaatattgtgaagaacatgcatgcaagtagtttgcttattaaccaggtttggtgtcagccacacacttataaagctaataattgctagctattaatattataactttagttcaaatattactgatgtctgttcttctaagactgaatgttaagattagaatttagaatttagtacaagtatgtataaatcatttcaacagaaaaaaatgaatgcaaatcaggaaccagctggaggcagatttgcatgattattttaatgctgtgacaggacgtgaacactcagaaattcgaattaggatgcttatttctcatatctacaatgagcactgagtctctcttatgatgtggccagctatcaccctgtgttatcagcaaaccctactaatagaaatttgagagtctaatatcaaacttactcttcctatttgttttctctgagccctgggttagaagactgatatgaaataagcatttttactatactgagctatacttatcatttacattattggtgttgcttagaaattactccacaggttttcaaaagataaatcatgccatttgattatcagcaaccatttgtccaatcagcacccaaatgcagtgtactctttgcactgggcagccactcttaagagagatttaagaagtaacaaggccatttttgtggataagtctagacaatagtcttttctgtagcatgaaactaatatctggtcttattgcatgatcatttttcttgcacctgctaaatcctttagtgccattcataaaacttttcataagaatgacttcatagaagtttctattctttttagagatatgattacctatctgctttcagtttacactattgcacttgtgtgtgtgttgtggggggtatcctctggtcttgtgcaattattttcattttagttactcaaatgaattgctgattaaaaagtaaattttgatggccatgtaaattggagatgattctggcttaaagggataactaggcaggtatttttgaaaattaataagcaaggctatcactccacataaacaaagcgattttttaaggaacagaacacttgatatactggttgatgcttcagtctggtgtggtatttgaagagcataaagtcgtaacatagattttcattttaatgggagtgttgtaataccttcataattttttttttttacttctcattagtttttacaacctacgaattacctaaaacaactttagtcatttgaattttgacttgccacttattttactatgtgcaaaattgtcccatttgagaaatggaatctgtatgtatggtattggtgtctatggctagacattaggactattacagagtttgcagatgtcactatgtctaatgcagttctaatgcagatctgtttggggttttgtttaatatatggttatggagaagtctagaaaggaatgacaatgaagtagtagttactgtaaatcttgtggtcacgtaatgaaaatttaggagacttttctgtacaccactttagctctgctctttgtagattgactcatctagaggagattttgtacaaatttttttcagctaatttctccagttcatttgtttattgatatagtattacattattatttagttaagcaaatggtctacaccacatgacttcaagcctcaatgtcttcttttttgttgttgatttgtatactaaatttcagaaatggctttttatggggaaggttggagacaaataatgactatatacacatatatttcacatatatatgttattgaaacatatgagtgtcatatatgtgtaagtggatgtagacaagtaatgagtatatatacatatacagtcatgtgtcacttaataacagggatacattctgaaatgcatcattaggtgattatgttattgtgggaacatcaaaaagtgtacttacacaaccctaggtagtagagcctactacatcatacctaggctatatgttatagcctatgacccctaggctacaaacctgtacaacatgctactgtactggatactataggcaattgtgacacaatggtaagtatttgtgtatctaaacatatttgaacctagaacaggtacagtaaaattatggtattatagtcttatgggatcagcattgtatatgcattctgttgttgaccaaaatgtagtgcatgaatatatatatatatatatatatgtatgttactgaatatgttatatatttgttattgaaacctacttttattattatatatatacatatacataaatacatagccccacttcttcagtcatgtgaagttacgcctactgatacgtgtattagtctatcttgtttcttcttgccacttttctctctactctgagcccattcacgtaacccattttaacaattacttatagattatttcataatttccttattttagttcatttctaatcattaactgtgttattgattaccccttatgtgaaccaaaaacatctccataggggcatttctttgagaggatcagttctgctttattaaaggtaagtcagcttatccaagtcaccagaactgagttaagaaacatatggggctgggtgcagtggctcacgcctgtaatcccagcactttgggaggccaaagcaggaggatcatttgaggtcaggagttcaagaccagcctggccaacatagtgaaaccctgtctctactgaaattacaaaaattagccgggtgtggtggcgcatgtctgtagtcacagccacttgggaggccgaggcaggagaattgcttgaacccaggaggtggaggttgcagtgagccaagatcgtgccactgcattccctcctgggcagcacacacacacacacacacacacacacacacacacacacacacgaaacatatgggcaatccaggggattctagctcttcagagtttgcccgggactaaaaatggcagtacaaaattgagcattggccctttgagatcactgggagcaaaccaaccaatgaggaccacccatgggaacagatggagttcagaactggactttaaatcggggctcactctacagagggtattgtggctggacagaggatgctcattgcatgaaaaggaatctgtttgtctgggtcagtggggaagagttctggtgtgtcagactgtcttattttgagttaaaagttttacaggtaaagatttgctttaattttctactcatgttgtccagtcgagtatggccatgtgtgcttctgtctctgatgagaaataataatgataaagatcatgagagcagcaggtaccactctgacaacgaagtgcccttctctgtcctagttattttaaaggtagcacattttttttaatcctcgcacaaccctgtgaatccatattgctttcttccttttacagataaggaaactgaggatcagagaggaaaaccaacttgctcaaggccaccaggctagttagtgttagacccgagactcaaatctaggactgcaggacttcctatcccaggtcaacgttatctagtgcttctcgacattttgagatcagtttaaatactccttattgtgcttttcttgtggatctgcaggcactgggtctggcactgaggaatcagcgatgaccaagacttggtccctgcttggagaggttcacaacacatgcaccattttattggaacatcacattacattatgtttaatgtgacataatacgagctccagatgaggagaccttttctttattttgttcttaaaacagtgcctggaacatagtcagcactcaatgaacatctggaaaacataaaatatgtcacgaaatcctgtcatggaggaaagcactctttgctttgtctgtggtttcatctgtgcctcactctgaattttactctgggctcctcacccctgatgcatttgcccacgacctcctggcatgccttgctgcccttagcattcattctgcagaaactttatggagcacatactgtgttctgtgcatatactgccagcattgtgctggcattagggacacagagacgaacagaccagacatggtccctgccctcttggaggaacacaactgctctgtacccatgggttctgcatccatggattcaactaaccttggatcgaaagtactcagggaaaaaaatatatgtctgtactgaatacatacagaccatttttccttgtcattaagtctgaaacaatacagtataacaagtatttagcatttatatcgtgttaggtattataagtaatctagagatgatttaaagtatacaggaatatgtgtgtaggttatatgcaaatactatgccattttataacagggacttgagcatctgcagatttttgtagttttgggaggtcctggtaccaatcctccacagatatggagggaccactgttctcttatacccagttctccttcatggttcagaatttagctcagctcttcacccacacacattacactcttccacccactgccccatgtcattaataggattgattcttaagtgtgtgaatggcagtcagagcccatgcacctcaactctgacttgaccagatgccacaccctggagtttctccataaagacctcctgccgtggattctcatccacttctttgagcatatggaatgtccatggtggaaagaagcagacaggtctaaataaacccattgactactgagaaaagaattaacgtgtatgagacccccgactatgtctcaggcaatattctagggcttttcctccttcattccattctcatagtaatcctgagggaaaaaaaaagcagtattttctttgtttttctggatgaggtccactgaggttagtggggtgtccaagcttggagagctagggagtagtagacagccgagataaggaatgcaggtccgtctttgtacaaacctgcttatctccatacaaacctgccatgtattctcaaggttatgagagaaccagggagggctggagactgagctgcctggtggtgcctatttatattcatgctctggaaattgtacatgtaactcattactgtggtcatctgctttctgcagcctcgtgaggggcccttctcatgttcctctgtagatttatgagcttgtacatggcacctccattctacggcagtttttagagttccctgaggattcttataacaatcacaattatttaggttctaaattacccttgtccagtgttaagcagatgagcagtgttttcaccttctaaacaatgattcctgaggcaactgctgccataatatcacatttcgtttccaaggaaactgcatatccatcccttcctcccacccttcccacttccttaagcatgagattttttaaaactcaaaatgtgccatttcaacctcttgttactgtgaaagttttagttccggcattggttcctaggaaattacagttttccttctgatcttcttcttaatgtgttggatgcttttctgcagaaagctgtgcattctaaatggcattgaaataaattactgccttcattatgacacacaatagatgaatgtattctacttcagagtcacagcttctttagccaaaataccttggttgttttccatcctgaagttctataattgcttacttgatattccattgtgagatctcagaataaagtaaaggtaggctgtggtatatatgtgtcttttactctcaggctgtacgtgcattcaagttacctgactggatggattcagtaagtttgtaccctccagataaagtaattactgaaactaagcatccattttctatagattatgttactagtgactaaaaaatatctccagatattgtataaatcatggaattcaggcagctatgtttactacaagtggcagtgaagcatttacttactccaaaggaactctggagtactttgcaatcctgctggaaggcaggggagatgtgggtggccacacagagtcagaggatgtcaacatgcagacatctgtgtaggcatctgagttatgctgatcgaagactctcttctcactctttagtttccccactccaaacacacacacacacgcacacacacacaaacacacacaacctcagaaaaccgtggtgagcagccctgtgtctacagatacccactcctggcaatgtccatgtagctaacttccggtcaccatgtccgtcccaggattgccttgagcctctatacctccctccagcctccaggcttttgatatagagacctagacatttggattttgtttttgtttttttccagaaaatctctctgagactcaacgcttaggtaatgtggaactcagaacctgactattttttttcaaagaaaggagcagtcatgaacagcctatgaatagatataagtagatgcagaaataatctgtatgggccaggcgcggtggctcacgcctgtaagcccagcactttgggaggccgaggtgggtggatcacgaggtcaggagttcgagaccagcctggctaacatggtgaaaccccatctctactaaaaatacaaaaattagctggttgtggtggcgggtgcctgtaatcccagttactcaggaggttgaggcaggggaattgcttgaacccggaaggcggaggttgcagtgagctgagatcacaccactgcactccagcctggatgacagagcaagactccatctcaaaaaaaaacatctgtatgtatttagtaggtaagggtgaaaatgattattatagtgtgtgtgggagtgggaggaaattagcccatgtactattggactggtgatgtttctaagggattgttgtatatgcgaaattgatcttccatttacctactcttttaagcacttgggcctggtcagttgacaaggtaaagttgacccttgaacaatatgggagttaggggcactgatccctatacagtggaaaatttgtgtttaacttttgactctcccccaaaacctaactataatagactactactgactggaagctttaccagtaacataaacaattgattaatacataaaaatgttattaagaaaaccataaagaaaataaaatgaattcattattcattaactgccagtggatcatgataaaggtcttcatcctcattgtcttcatgtagaggatgaggaaccagaagaggacaattggtcttgctgtctcagggttgtcagaggtggaagaaaatccacatattagtgggcctgcacacttcaatcccatgctgctcaagggtccaaaggaactttggagtactttgtaatcctgctggaaggcatgggagatgtgggtggccacacagggtcagaggatgtcaacatggagacccctgcataggcatttgaattatgctgtactagcttctggtgggcagcaggcctggagccagtctctctggtagagttggatggggccaagagggtataagtcttactccttcttcccataggagaatggaaagggagcttccttaagggatcctggccctgcagggctgtatggtctcacaggcaagggtgcctatctgctgggagaaaatgctttgtgtgctcatattcatgcaagtaagttcttagattattgtcttacataaagtgatttgtaccctttgcctatggttaccaccaccacccctgtgataagtccatagcttcccaaactccaggcacatagaacctttctgccttttttggatccacctctgtatgcagtggctctggacttcttggtgtccccacattggtctgggctgaacctgacaggccaatagacaagggagtgaactatggatgtactcaagttcattaagtcacacgtcattgtgcttagtgaatgtggcaatctgagacaaatacgccctttgatgaatagagagtagaatgactaataagagatcagaagccagcaaagagtaaatccaataacaacaacaagaatgtagagtttgaaatttcttaagtttaaatgagaatgttagcttattttgcaaatagctttgtctttttctgacccctcctcccaccatgtggaggtatggaggagagaaaggctcttgcagaaaagtataagcggtgcaagtggagagtgctgcagagatggagatggaggccaggtctgctggtgaagggtcttatagtccaggctaagatgttaagcataccttagaggcatgaaagaatctctgagggccattaagtggggaccgaaattctaaaagctcaattcttagcctggttgggggatcaatttctagttattggatcacagtggactgaattctgagagctcagtgtgacagataaaggaaagtttgtcagatggatactgttttctttataagaatcttctgacttttggggtagagtttaacccctcattttaaagcaactcattatgtctcgttggtatttaatgaaacgaaaataatgtagtatgtgacactcatgacatttcacctgtaaagtaatttatggtaatttgtcctagagtgttctatcataggttgataggattcaaggactatatacttgttttctaccctaatagataggagggtggagtaggatgagaggcaggctcagagataggaagaaaggattttttcatagcaatgcaaaactgttagaaaagtgcatggtactccaacctttcagcctagtgacttcttgctgccgtggagtggctgcagtttccttctttgcaagtttggagcatacgcccagatgctggaaggatttggtttacattatattgaaaaataaaacaagacaagtcaagtaaaacaaaacattagcaaataaaacccataagcaaacacaaataaaatgatttagtgaggtaatttctcacaaatttcagaatttcccacaatcgtacagaaatggttcttgcctgtggctcacatgggcttcaagaatttaatttacccgtgttgatcagatgtgtaaaataatggttccatcattggttgcaaaaacttcaggtgttggattttggaagtatttacttacagaggtctcatcattgtaaggtaaagctttttagccatccaggccaaatggtgggattgagattccatctgccattgttcttacggacatctaaaaagagcaagaaaggggtttttatatttatttgatatttatactcccatccccagaagcccatttaaaaattggtattggttctggtagcagaaaaagtggaagtgaaattagagtatagaaacttatttctcaaagtgtggtctgcagactggccacatcagcatcacttgggagcttgttaaaaattcagagttgctggccccacaccatctcactgaaccagaaactgcattttaccatgatcctcagataatctgtctgcacattaatgtttgagaaccactgaatggggaatacctttttaggaagcatggtcatgaagaaagtggagtggttgtggagaaggtcctagctagagatggagcatgaggtcagggcatttgtttgtcttaaaaaaatttagacaagccttgagcatgtttatacttgtggagaaggagacctttgaagtaaccagacaccaaaagacaaataccatatgatctcactcttacgtggattctaaaaaaaaaaaagaattgatatcatagaaacaaaccgagtagaaccacagttactaggatactaggaattggggaggtatgggaggcgaggaggatggggagaggatggtcaacaggtacaaagttacaattaggaagactgcgttccggtgttctattgtacagaagggtgacagtggttaacagttaagatgtgatatattataaaatagctagaagataggcttttgagaatgtcctcaccatgtataaatgataaatacatgaggtgatggtcatgctaaataccatgatttgaccattatacaacatatatatgtatcaaaacatcaattgtaccccataaatatgtaaaattacaatgtgtcaactaaaaaataagaaaagaagttgaagagaaagaagaggtggctgaggtccctggggagctagagggctgagatgtggtcataggagggaaagtagactaaagtggatgaatgacacttgttctcctgaaatgagagggaaggaagagcgggtaggctgcatgtaaattagcttgtgtattgaggaaactggaaaattgagagtagtaaaaaatggtgacttatttttaccgatgatggaggtggagtcactttttgagcataaaggggcagacctggtcatgggatttcagaaaagttcagggccccttagaaaaacacactgatgggtatgggaaagaacaggtgggggtaagggggcctgagttataggttgctttggtctcccccttgtacaattcaaaacacctttcagatatgtagaatggaagaagtacccaacattgatgtatattaaattccagccctgaacatcatataattaaagaaactaatataatactgatataaaatgtgggactgttttgactgtattggtactttctttttcccaaaaaggcagagctgcttttgcatatgaactcattttcttcaaaatccattatcctcatgtgagagatgtagaattttgggcacagaaaacatgacaaattttgcctgtagtcctgaactgagattggtaccaggctctgctggcttccagctatttcatttcatgatttatcaagagctgctctctagtcgacttggaaaaagagtttttgaagagtcctgctctcacaggacatctgtgagaatgccgaaggagaaggtaaagagaggcacgcttcaatattttattatctcaacccacagccttaaaggtctcctcgattgtctctgcctacaggaaggctcagctgctttttatcattccgttggggccttgtttcaggggcttgtgttttggtaagaagatgttttgtttctgaggacagctggttaaaatgcactgccttaactggaatattcacaggtatgttcttctcggcactgtgaatcatttttcaaagcttttcatggcttctgctctttgatcaggataaatcatgccacagtgagactggaatccactttcatagactcccaggtgtccttgttctcacccactggtctttacttctctgaagagcctgaccttatgaattaaattctttccgattgtaacattagtcagaggaattggggaactggggacttttgtttattaatccttttatcttctgcttttttgcccagaaaggtcatttttcaatttccccagaaggtaattctacttctcttagtaattctcaacaaatgctaagcttaggacatttatataaaagccagaataaacattaagtttagaagtgtcatataaaaactagaaacaagcttttgtgcttctgagtataacttaaattaggtagaaaaaatatctaataataaaagtagattcttctaccctgtgtagggtccacaaaggaaaaaatatggcctcttctttttaggagtctagatcccactttctcaaagtgccttccttcatgtgtagccaccccacttccagtctacattggggacccccaccattagaaaatgtctttatttatttatttttaattgtcaaaagattgtatatatttgtcacacacatgttgttttgaagtgtgtacattgtggaatggctaaattgagctaattaccataagtaccaactcacattaagcctcccttctttatcttctcttagcgtccttgatttcctccacaacatttaacataactacggtatatttatttgaataaatattggtttaactgcttcctccctgccaccccagactctgagtcccatgatggcaaaagccttggtagctgtagtagatactacatatatctttgtggaatgaataataataatactagtggagaatatttgttgtgcttatgatgcaccagggactgggctaactgtgttactcatcctatcttactgatcctctgtcttagcctgcttaagttgccataacaaaataccatagactaggtggcttaaacaacagaaatgtgttttcttgcagttctggaggctagaagttcaatatcaagggtccagtgatttgatttctagtgaggactttcttcatggcctccttcttactgtatcctcacgtggtagagagagagtgaacaggttatctggtgtctcttcttacaagaaccttaatcttataggaccaggtccccacacttctgacttcatttaattttaattactttcttactcctaatatagccacactggaggtcaggactcccatagatacattttgagggaacacatagcaatccataaaacccacctaaccaccctaatgaagtaggcactatgatcatctctgttatacagatgagaccctaaggcttagaccagggagctttctcaaggtcacatgagtaagtgaacaagctggggcaaggttgtaggtcttatttactcaaatctgggttcataaagatataaagatctgaactggttacatatactttctgtttggaagaaatgtaatctgagatatagagtacgagcttaaaggactattatatatgcaaggaagaaagtttataggctaaaagagtggttctcaaaccttgcgttttaggacccttctacattcttaagaaaagtattaaggatctcaaaaagcttttgtttatgtaagttgtatctgttgatatttatagatagcattagaaattaaaactagaaatatttttaaatatttaatttatttcaaagtaataataaacccattacatgttaatacaaataatatatatttatgaaaaataattatatttcccaaaataaaaaatttaagacatttaagacattttttgcaactctgtctcaggtctgtcttaagagaagacatagatatggattctcacatctgcttctggatttactctgttgcaatatgttgtattggtaaaagtagatgaaaattcagcctcacacaaatgttattggaaaaaggaggagtatttgatcagccttttcagataattgtggacattctgttttgttactacagcaaaactccaattggtagttttctaaaggttagttgcgatgtgaaatctgaaacggaatcaatgaacttttcatattctgttactttgaaatccactggtctagcttgcactttgaatggatttttcactcatgcatgattttgtaacatcttgcattggtcatttgaaaatatcagttcactgagttaatacagatctttgagatgttgacacatttcattatacaatatccaaaaatcacattccttaatattaccactcaaatatctcatcagaaaaggctttatgtactgggaagctttcaagcccatgatggcagatgtgagttttacaaaatccgaatttttgcttgaaaacaaggtttttatcattggcatcaatgactattagttgtttttcttaaagtgttaagattatttcattcatttagaagaaaacatctgccaactgcccacatataaataactttacttggttaattttcctttcaggaaaaaattatgttcatgaaaaaagcaattatttgagtttgcaactcaaacaattgcacaagtgcttttccttgtgacaaccactgtatttacgtgtgtagtagaagtgctttatacattttcccatttcatcacacagaatattaaaaagaatgtgtactcaaggtttaataaaattaataattcttacttctccttcaaggacattcttaattgaaactagtatttattttattgagagtacctggctgtgaagagtacatggctgtgaagaacacatggctactagcacagtttggagccactgccttaatttgtgctaaggcgctagcaattttactgaccattgcttttgtatatttggtgcaaatgtcaacatggttaaaaaaataaaaggcaaatacactttagtattctcacaaagacagttttgaccttgtggttccctagtaaggtcttagggagctcctaacatcccctactccccaacattcctccaggatcaagggcttcttccatgagcatgagttctataaaggaagtcaggaacaagcatgggcttggttggactgtacagttcaagaattagggaatttgaaggagtatgggtgaggaatagggaagccattaactgaggttggtaagaaggagaaaggtttttgcaaggagtcttagagctcagaagctcagattatgaggtgatttctctttaaggaaaatcaggagtttctgtaatttgttgagacaaaaatgacactgtccatgtgtttccttatctgtaaagtgggaatataagagtattattattgtgtgaattaatgtataaacagcttagaacagagcttggcacacagtaggtcctatataagtgttattattgtgaaaatggagttttgctctagttatatgatgaattggagcagctgttcttacacttcagtcagcagcagaatgccttggtgggattgttaaaatacggattgctgggccttgcttctggaatttctgactaaggaagtcggagatggggccatgattttgcatttttatcaggttcctgggtgatactgatgctgctcctctgggtagcacactataagaaactgaatcacaggaattcacacaatgaatactataaatatcaatagatacaactcatataagcaaaagctgtttgagattctcaatacttttttttttttttgagacggagtttcactcttgtcacccaggctggagtgcaatggcgcgatctcggctcactgcagcctcctcctcccgggttcaagcgattctcccacgtcagcctctcgagtagctgggattacaggcttgtgccaccatgcccggctaatttttgtatttttagtagagatggtgtttcaccatgttggccaggctggtctcgaactcctgaccttaggtgatccgcccacctcggcctcccaaagtgctattacaggtgtgagccactgtacctggcctctcaatactttttttaaagagtgtaaagggattctaagatgcaaggtttgatgcccttttctttcctagctactcaacaagccaatgcctcttattcatatccatgtatggaaagtgatgtctacttattctttcacttgttttcatttaactttgctcaagaactgaagtttaccccgtgtttttatttttatctgaacaataagctgggactgtaactggttcagtatttatattttttctagcatgtcctattttgctgtgcctaattgctattaaagccagatggctgggttccaaaaacttgtctgatttgccaacagttttactcacctgaacaattttcactggctctaagctccctgacttatatcacaggccatcattgccacttttctgaacttgccagaggtcttagaaatgtagactagttgttaagattgctgatgaagatgtgctaaatgaagagtgttggtagtttgatgattaccaatgatgttgattttaaatcctacattcacttaacaaatatgtgtgtgccaactgtatgcaaggctttgtgctgaatgctgggaaccaaaccgaggaaaaaatatgcatggactctgattgtcagtctgggagacactaaatcaacaggcaattataaaacagtacaatgtcacaatgtcaagggaagggcaggaagataattgggctgaaggggggatctaatccatggggggcagggaaggctttctagggtaagtgatgcctgagctgaaaacttagaggaggctttgaattcgttaggtaaagaaagcaggcaaaaagcatgacagtatcccaggctaaaagggacagagtgtggtaagacctagaggagaagcagcacacaccactgtctttgagaagaagtttaatttggctggttcactgagtgtaggtcaagatggggatgtagaaggtaggaaatgacaagagggtagaaagattaggcaggaccctctaagcctttggggtttctcagccttagcactatcaacattttgggctggataattctttgttgatgtggggtgggggactgttctatgcattataggatgtttagtagcatctctagcctttgtcctaaataccaagagtgactcccatccctccagttttgacaactaaaatggtctccagatatttcaggtatttccaaatgtaccttgtggaagtaaaattgcccctggttgaaaacaactgttacagagttttgcctttatttatgtttttgttgttgctgttatttgtttgtttgttctgagacagggtctcactgtgtcacctaggctggagtgcactggcacaatcagggctcactgcagccttgacttcccaggctcaagtgatcctcccacttcagcccccaagtagctgggactataggcatgtgccaccacacccagctaattaaaaaaaattagtagatatgaagtcttgctatgcttcccaggctggtctcaaacgcttgagctcaagtgatcctcctgcctctgtttcccaaagtgctgggattacaggtgtgagccaccatacctggctttgtctttatgttgagaacagtggtgggcaattataagattttattcaggggattgacctaaccagatttataccttttggacattcatttatagtaacagtatggaaaatgaacagagggttggcagcatttgaggcagggaaacaggatgtcactgttgcagcttggatgtatctaaagaagtggctgtaggaatggagacaactatgtacacttaagatataattaggagatagatttaacagggtttggtggctaattggacatgaatggtggaggagagagaggaatcaagtctgcctcaaggtttctggccttggtcctgaagaagatagtggtgcttttcactgatgaagggagcacaagaggagggacatacttacttggaaagtcaggagaggattgctggtattttagatatgtcggatttgaggtgccttgtgacagccaagtggagattttcatctgtaggtagagttcggtttctggaacttaggagacagaactgagccaatcagcaactagagggtagttgaaactctgggcaaggctaattaagaaaggctccactgaatgggaaggcctggggactaagagccggtcctgggtgacaccaggtagatcatggcaagaggtggaggggctggtgaagaggagatttcagaggaggaaatctaggatgtggcagtgtcagacaagttcagaagagttagctctgtgaagagaagcaaagtttccatccatggctcaaattcttccctttccttcaacaaattcaagtttcatgtggttctagatgctcattagggttcttctgaaacgattggatcctccaagacatagaaggttatgactggttataaaaattgccacatttacctctggtataacccaaatagaagctctgcatcataaaatttagagttgaagacagatgctgtaacttaaaaggattgatgctgggccagactgctgaattctgtagaggctttataatggagacacatctttctaggcagatatcacttgtcacttccataaggaaaattccctggagttgatgagtagtagagctgtgcttctgctttataaaatccacttttgatgaaaaattaacattttaattcagaggtgtgtagctatcaccaaagggttatgatgtcatgtaactaagtctcagataccaacattgttcaatattgtataattttttccagagtggtatgtgctccagataactgacctttgaaggtagtaatgtattatttacatgaaactaaaatccagtgcattctaaatggctgtgatttatcatgaccattttgaaattgggtcctgtggccatatgctaatttgactcaaaggaaattctgtgctgtgtgcttggatttcatgcttaaaaaattcagcaatagtttcaatgctcttttaattaaaataagatgctttataacatttcccacatgatgtggaatgtactctgtagctcatatatgaattaaaacccttagaagatttacattttctggtctggcaaccttcatttttctaatttatgtgtcctgtttgtcctgaaggagttgggaagttgaaatttacagccatcccaaatgagagagttgagattcttgattaaatgagagcttgtttgtgtattcaaatggaaaaatgtgggtggacaaaattaaatttgtagtgggttatctcctgaacagttttctctttcctggtaatttcacactgcccaactatgcacatggtaagtatgggagaaaacttttttgtataataaaactttttagcagtaactgactggaccatggttgggcatctattccaagttattctgatcagcacctgcatctgagactttgtaattggctctatcatattcccagtatgccttttgtgtgtggccattttctgctatgtaaataggaaaactgaaaaatcaggtctgcagaaattgaagaatgaatggggagaagcaaagacaagcaacagagagaaagaattcccagtcattcctggtgcgctgcagtctccagtttctgtgagtttccaagacccagctcatccatgcctttggggtctttgaaagatccctctatctttcaggggtctttgaaaaacccctgtttatttcaaccagctcagatggttgcctgcatgtgggagcaatgaaataacctatattgcttagatttctattttctgattagatggtggctaccatgctatgtgtatattcttaaaacaagcccttgtacataaattagataatattggatggttttggttgagctggtctttggcttaaatgttattgacatttttctgaaaaaatataataaatataggacatgtataatctcacacaagtttgaaactatttaatagactcttaaaacaaaggaagggtgtctatgtagatgtgctgattggttccaggtctaggaatccaggccatttgcagtttgatttgtggagaaggaaaagagactacaatctctcagtggtggtaaggaggcaggatggagtggggaccagaaacgcctctgagatacaatgtcccaaggtccagtgtttttatgattgggaggaagactgctctaaaatctttgacatttgaagattattaataataaatgtcctcactaagttcctctgttcataggatagtaatacaaaacaaattgtaccccaatgcagcagtgtgaaaaaaaaagaaggaaaaaaggccaagattattaaattcttatgttcagactgagaaccagaaagcaaaagagagttaatcattgagttgtgtattagtctgttctctcactgctgataaagacattcctgagactgggtaatttataaaggaaagaggtttcattgactcacagttcgacatggccagcgaggtctcaatcatggtgaaaggcaaaggaggagcaaagtcatgtcttacatggtggcaggcaagagagagggcatgtgctggggaactcccctttatcaaacaatcacattgtgtgagacttactcactatcaatgagaacagcatgggaaaaatccacccccatgattcaattaccttccaccgggttcctcccacaacacatgggaattatgggagctacaattcaagatgagatttgggtgggaacacagccaaaccatatcacgttggaaactgaatgtataggtggtcctatggctagatgtcactgatgacaactgtttgcagtcttctgtgtctggaaaaaaaataatagcttccctgcttaggaagtcagaatataggcggtagggagaaaaaactgttaaaaaaaacttcaaagactggaataaactacatttttgtagagctactatattaaaatataagaggaaaaagaagtggaaaagccggggagtggaaatcgcaggcctctgcagaaaggagataaacaagtgcctttgggtgggatcatttgtgattgtaacagaaagacatacaaaaagacaagactatgtccttagaagcagagtggcaacttcaagtttataattactaagaacccctatgtacacagcatttggcatatgcaaaatatattggcagatgcattagtaaaatttaactatcgtaaagcctctgggagcattgacttggtaaagtaacagaatctccattaaagcaaaagtaatgaactgactcagcactcctgagtaaagtgaccagatgtcagaggtaccctgaaggacacagagggcaaatcaggtgtattttctggctacaatcggaagggtggcacagagagaaacaaaaccatgaatacatctttgatttcaggtttaactcaaaggcagtgatatttacctggagagcagaggaaagcattgatgcttccaagccaattctttaaagaggtgtgggtggagagtgtgtgtgcatgcatgtgtgtgtgtgtgtgtgtgtgtgtgtgtgtgtgtatgtacatacacacatatacaattagctccaaggctttaaataaattcaacacaagtatttattcagacctttgttgtgtaaggcctccaccaggtcctgggagggaatacatatgtgtgtgaagccctaagctttgtttaaataaagctaagggtcaaagaagagtgaagagcaccccacctccaccccaagttctctcccccagcctcttccagtcatggctcttgggaaaccctgcagtaggaacagatgaatgtgtgtataagtagttggaaagggaagtagagatgatacttagacaacataaatgagagaagtgtgaagtgtttgcagtcagagtacctattcccaatagcctgcttttcatgctgataaaaccattcaatcttggatgttgagttcaattttttgtcagtgaaaaatctgcccagagtcttaaaaaatgcaagcaagtcatctgtatatagcctcagagcattgtattttcaatgtactgatttgctaggtatatattgaagtggcctttggaccctgagtgttaaatatggagatctgaatgttcttcagttcattttaattgtgacgaaatcaactattgaggaagaacacacttcctgatatagtctgcagccttatagagagccaagtatgtcacctttaacatataattcaagttcatttgttctgattaatttgtggggagttgcaggattggaatttagaatattttaagtgaaattgttggattacggattaaaaaaattacaaaagtcaattatgtacaagttctgggctaggtcctagggtacatgccaaaggaatgtgaggatattcccagtcttcatttcagagcagagtcacctggagcattttagaaaactcttgagactcaggcagcactcagatcactggagggggcacttagctcaaataaatcagaatctgcgcagggggtgcccatgcattactcagttgtagagctccctcctcaccgggtgattccaagtgcagccatgtgtgagaactagatcaacagtctggaaagcttataaaactacttaacatcaatttaaatataaatctctgggcattagtctgcggttggtaagttttacaggctctccagatgattctgttgcatgtggaagatttagaatcagtggtatagaccctgctctacagatgattatggtcaaatgagggaaaaggtgacttgtgtattttttttggaaaattacaagaaagtttatgtttaaatgccaaaagaataaaagacaataaggagtgataagaaaatgcaagaggtaaatatttagtgaataaattaaaaatgatttgtatttagcatgtttattcagatggaaatagtatttttaaagtgtataaatttttagaaatacatttttattatatattttcactatgtattctactatatagatataaaattacctaataggtatacatattttcagggtacctgtgataatttaatacacacatataatttgtaaagatcaaatcagtgtaattggggtatccatcaccttaaatatatgtcttttcttcatgctagaaacattcaatttattatcttctagctattttgaaatatatcatagattattgtaaactgttgtcaccctactgatctatcaaacactagcttttattttttctatcaaacagggtgtttaatcaacttttatcaaccctttaatcaacctttgtttatccccttacccccactactcttcgtggcctctgctaaccaccaatctgctctctatcttcatgagatccactttttttttaattccccacagattagtgagaacatgcaattgttgtctttctgtgcttggcttattttacctaacataatgacctccacttccatcaatgtggctgcaaatgcctgagttatggctgaataatattccattgtatatatatatcacactttctttacccatttatccattgatgggcacttaggttgattccatattttggctattataaatattgttgccataaatatgggggtagagatagtagatgaaaacttaatcttcttatctgaagaattacttaaaattctaaagtagaagagttggaattgagaactagatagatcatttagtctctgatgatctgtctgtttgcagaggggagttgggtggaactgggtgctctgggagtactctgatggtagaaagagtcctttttattccactgtggaggtggggatatgtccttgggtgtggttttgagcctggatatccagaagcagtgtttctcaaatggcactattctgtatattcctattgcacgacgtgtatcttcttgctaaaatcaggcagtatcactatttttctatgggatgtggggaatatttgatagaaatattggtagaactttcttattttaagttttatttccataatcttctcttagccctttggtaactattactggtagtctcaagaaaatcgagtgagagataatatgggagatttctttagattttcatagcacttcatctgagtaccaatagccttggattcttatattaataacagtaccctaactcttagggttctttcgcagacttagatgaattgatatatgcaaatgtgcttaggaaaatgccatgcacatagtgagccctcagtaaatgtcagcaattctataacttcccttccactgctgttattcccaacgtcatttgcttcctgaactgtgggacccttgaggtcaggccagatcttttatctttatattccctgtctcctagcacaaggtttggtgcagtatcaacacccttcaacatgtgctgaatgaaggattggccagcttagatctgatttaaccctaaagaacttatgcagttattttaagagtattgtatcagtgtttcagtgattttctccctgagtgaaatgcttccaaatgccctgctatgttaacagtgcagagaatggctgctttagaagaaagagccccttgtacactcaatagtccacagcctccccctttaccttcctgatggtgggcaggtcactacatctccccatctacctccctgcttgcttagggttccctgacacacaggtcagccctgattcatcattccctacagaagactgaccttggggccaaaaggctggtggatatgatagaggggatgaggagaggaaatggatcagtgacattccagctggacacctgaatcccttttcaaaagagcatcttgttttgtccccttaggcatcccctaagggaaagttagcatgcagttatgaatgagaccctcgctgctgttttgatgttgtaaaggaggagggaaatctacaatggcattgaggaataatgcaagtgcatatatttttcctcccaaagaacccaaaagcatttccacctctatgttatctgatgctgctgattttatgcttcaaagaattgagaatgaatacctggcagtaagtactaaatctatgtgtggtgactgacagattaagcactagggatgttaaagattagaccacggatccccaaacagtgaatgtcagtgttattttccatcttgaaatggaatgaagttgccctcatgattcttaccacagccagcactgttatatcctcccaatttggttcttacattacttcactcttcagaacatcattcatttatttaaatggtatttcttgagctcttttcatattatggcttggttctagctacagagaaggatataacaaaatgtgagacatggtctttggacccaagaagcttctatttcaagaaatggaaaaataaggccgtaaaagtcatgattacgtgcttaagttctatgattccatggtgaaaggatattttgaagtacagggaacagcacagaaaataatgctacctttcaggataagtctaattatacctcttttgttgtcagcctgtgagagctgagggtttgtggcttttaattctcctttaggctgtggaaggcagtgggggtgcggaaagagtgtgaccattagagttagttctggattcaaatcccaactctgctgctttccacttgtacagattaggcagttgacaatatttcctagcagaactaaatacatccacatctttcagagatgtgaggaattgcactaatgatcacagctggaaaaatgctgttggagttgggcggatcatgaggtcaggagatcaagaccatcctggccaacatggtgaaaccccatctttactaaaaaatacaaaattagccaggcatggtggcgggtgcctgtagtcccagctactcgggaggctgaggcaggagaatcgcttcaggagaacccgggaggtggagtttgcagtgagctgagatcgcgccactgcactccagcctggcgatagagcgagactctgtctaaaaaaaaaaaatgctgtcgttagaaaggccttcaatagatggtgattgttataaacaatgatcactaacagtaaagatactgcttttatgaagctcatgcttaaatgataacttccagcaaaacaactccatttaagctgttttctttgtactacagaattagcacttttcgtccctctaaatagacagacaatatatcatggagaggtgtttccttcccttgaggacgcaatatgctattttatttttcattccattgacatttcttaagaattcccaaagaaggaagtctcagctggcctccttccacatattaagagagaaatgttactccattatgttggacttctgattcctctttctataattttaatagtcactgtgttgagtagtttgcactatttttctcatttaactatcctcagagttccacaaagtaggtgttaaccccattttacaaattggagcccaaattgcccagccagctagcaagtcattaagtgggatttgagctctggcagtctggctgcagagcctgtgtttctcactgtgatgctaggctcgcctgcctgtgtgcctgtcccaccaagctcagggctgcactgcctccacaactgctccttctgctcctgcctatataggctttagtgccatttgtgagaatacacagtaaaggtagtgtcttcgttagctttctgtggctataacaacacagattgggtagtttatcaagacaagaagtttacttagctcacaattctggagacttggaggtctaaaagcatggcactggcatctggtgaggttcatcccaagacagaaggcatcacgtggcaaacatgtgagatagaaatgggactgaccccactttgtcgacaactagcccacaccggtgatcatggcattaactcatttatgaggtctctggtctcatgagttaatcacctcttaaaggccccgttacttaatagcattactaaggcaattcaattttaacatgagttttggagggggacattcaaaccataccaggtggttacccacaacccccattcaaattgatggtaaataatgaatgttaaatttatcttctcttcagtattgattcccatagtccatattctttactggctgttagattttcaccttacatgctccaatgtgcctaacataaaatgatcttagaacctactttgtgaagatgctgcaccatcctgagatggcacaagaggaaccaggccctgagttctgctgctgtgcttcagggggggcctgcattagccatctctggctgttcccactcaagagtgcccccccccccaaaaaatagttcacccagaacccatgctagtcctttcatgcctcagggactcaggatcctgtaacccacttaaacatcacttacctcatctcagggcctaccaagacctatggcctgggcctgccctcctgaggtctgcctggcaccaccagtgggagcacccctagaccccagggatatacagtaactattgggatgatgctataacttgcaggctgtcctgatgatcattaaaacagtgattcagtatgaaagtgctttgcaaatgatgagatgtcacacaaatttagccactgtttggtcattttcactttatctttgaaagctcgtgtttatagctaaacatttggttagaagattaaagtctatgaaaagatttggatccagtaggtcacagcttactagaaacagaacagagacttaaaccatgtgcctctgtcttctggagttggacttttaccatgaggttgcttatctggatgaaatctgagggctttacagtctaactttctgagggagtcattcagggaacgttttagtgtcaagccattaaatcacacctcaaaaggttggaagtggcccacatatgagtccatataggtgggtctggaaaggtggggcgagcaggaatctctttccattatgatgatggggtttctaaagtaattattgctttaaaaaaaatctgcctctgccattttccagtcacactgttcttggagcgagatgcatcatcaatacttttcatactaaacgttctctcctattggatttacctggattctaggggtatttttttcacatttctctggagacaagtagtgctgataaagattttataaggtctctcttgctctcaagctcgttttccttaacttttcttgtcccagttaccagtttatttggtccccagaaaccttctaatcttcatctttaatgataaatttatcttttgtagttctcctgtcaaagcttttgtgtctagtggctcattttgcttaattgctggagttttctctggccttttgttatttggtcctgcgtattttcaaagattctgtagaattttcagactgttactctgatgtttacttggtagattgattgctaagttgcattgtcttcagaggaggtttttgaggttgtgtctattataatgtctgcttctacccggagtccattgcacttggagtgcttcttgaagcccctgagcttatgctgtgataaaagcgtgaatgttttactgtgtcaaagcactgtggctcataaggcttcataagctctggcttttatatcagagcatctcatatggttgtgcagattgcatcctggtcaagcatgccaggatgaggggccaagggtgtactgaatgccagcctgtgcttcatttgccaagccttgcatctgatgtaggactgtatcctcacaggggacaccttttcctaatacacacaaaggtatcatgtgggctagcagctgttctgctataacttagctaggtgtctttacaggagaaggtagtggaagaggtggtggtatttctcctcgggaactgagattagcttactcgacgggaatcttgaagtgtcccaagatgaagccattggtgccccactcccccaacagttgtttaaaagttattaaagaaccaattgacatttgctagcattttaaatgctcaggatgacttatgaggctatgtcagttattctttactcagtaggggacttggagctacaggtctgatttcagcctctgtgcagcccccgggccacccttcctgctgaatctaagccccactctctctagaggattatcttggggtttattttggctcctggctttgaatctgaattgctgcccctcaagttatattcaaacaactctattaagataacgttgtctccaggggctccaaccagccagtttcattttccaactagtttggttggtcagtgcccataacaggtccacttgaaattagagctgcgtttttttttttcttttctttttttctttttattattttactttaagttccagaatacacatgcaggacatgcaggtttgctacataggtatatgtgtgccattatgatttgctgcacctatcaacccatcacctaggttttaagccccacatgcattagctaattgtcctgattagagctgcattttctagaagtcaacaacatagtgtcttgaaagccttctttgtcatattgcagttgtgtctgagacctttatgtaccttagtttttttgggttttccttccccatgtgaaccacagttaccctttctctgactagtatgctgaagttatagtacatttctatttagcaggtgtttcctgtggttgccttttgttctaaatctatgattgaaccttatctatattgaaccaagtctaatatctatttgcctggacacctgtactaacataatatgattctttttgtatccacccttatattaatctggtaggatttccataacaaaatactgcaggctgggtggcataaacaacagaaatatatttcttacagttctggaagctggaaatctccaatcaaggtgttcgcatgtttgctttctcctgaggcctctctccttggcttgcagacaacttccttctctatgtgtcctcacatggacatggacttttctctgtgcatatattcctactgtctcttcctcttatttatttttttgagatagggtctcgctctgttgcccaggctggagtccaatggcatgatctcagctcactgcaacctctgcctcccaggttcaagcaattctcctgtctcagcctcccaagtagctggggttacaggcacctgtcaccacacctggctaatttttgtatttttagtagagacaggatctccaactcctgacctcaagtgatccacctgccttagcttcccagaatgctgggattacaggcatgagccattgcacccggcctctcttcctcttcttatggggacactggtccattggattagggccccatgcttatgacctcacttactcttaattacttctttaaagtccctatctccgaaggatatgaacagacacttctcaaaagaagacatttatgcagccaaaagacacatgaaaaaatgctcatcatcactggccatcagagaaatgcaaattgaaaccacaatgagataccatctcacaccagttagaatggcaatcattaaaaagtcaggaaacaacaggtgctggagaggatgtggagaaataggaatacttttacactgttggtgggactgtaaactagttcaaccattgtggaagtcagtgtggcgattcctcagggatctagaactagaaacaccatttgacccagccatcccattactgggtatatacccaaaggattataaaacatgcttctataaagacacgtgcacatgtatgtttattgaggcactattcacaatagcaaagacttggacccaagtcaaatgtccaacaatgatagactggattaagaaactgtggcacatatacaccatggaatactatgcagccataaaaatgatgagttcatgtcctttgtagggacatggatgaagctggaaaccatcatcctcagcaaactatcacaaggacaaaataccaaacaccgcatgttctcgctcataggtgggaattgaacaatgagaacacatggacacaggaaggggaacatcacacaccggggcctgttgtggggtggggggagcggggagggatagcattaggagatatacctaatgttaaatgatgagttaatgggtgcagcacaccaacatggcacatgtatacatatgtaacaaacctgcacattgtgcacatgtaccctaaaacttaaagtataataaagaataaaaataaaataaaataaagtccccatctccaacatagtcatactgggaattaatgctgcaacatatgaattttggggggcataattcagttcataacaattttcacttgccagactttcttatttaagcatatccagtagatattagaacaaaaacaacgtttaatttataccttttctgtccatttgggctcatggagctatgttaaagacttcatttccatcctcagaaaaacattccatttagcaataattatactttggatcttgccccttagacagcttcctaattgttatttccaaaaatctaagcctcatttttggaaactgctcccctatgttaagtatagtgaaacgcttccagacaatctcattttgttaaaattaaattggtgttttctggaccatgtttgtcccataagcagcattctcaaagggctcggcaggctggggcccccagcctgtgcttgtagacatcatgttgatttttaatcaaaagccttattttggcagcttccgtttttttgattgtttgaaaaatacttcctgatggcttggagtttagattctcagttgttggatcctgaagaggagtttgaagccttagtttttcaggaaaaagcacctgacctgtgtatcttaagctgctaaatatttaggaagcatcagggcttatttccacttctaccacacaatattgaagcaattcaacaattgaatttttttttccccgctagaaaagagggtttttcaggccactttgaaattcaggtggttgatttaaaaatgcaaattctttgggaattaatcatgaaatgtttcaggatttttataaggaagctcatccgctcagtgaaataagggatgctttcttggtcatgaattttctttttgtactattttgttagttacttggtgggctagacagtatttttgggtgccactggcaagtctaaaacacaggaagggagaaagaaaacagctgacacttacaaagtctgacccgttctgtgctggaaacatttggtaaatggttaaatttactgcatatgcttgaaacgaatagctgaattaataaatgaatgactttattaattcaagctgttctatttttcaaataatccgaattagggatagtggcagagaccatgtatgctatgtgatcattttcctcctgggcacataatgggaactgtgcaactcactctcaagtgttgttgggtagggccatggggttggattctggccaatgggatctgttaggaatgacatgtggtacttcaaaacctaaaaatcctcctgcatgatcctctgcattttctgacttcctttatctactgactggagggtgctaggagatggtggaggcataagacagaagtatgctgtgtcctcgaaacacaacatggagcagagcccctatcaatgcacatgaagccacaatgtgattgagcaagaaataaacctttattgttttaagtcaaggaaatttgattgtgggttgtttgttacagtagcttgtgttaatttttaaaagtttcatgatggtgtagtttcttagtatcattatgctgaaaaatatttgacctgaaagcaacaaatactgcaatcaaagtacctatgccagtttctgttctattaaaaacaaattcccttgctctatttattccaactaaaatcacagagatgtgctaatttacaggccagcagagtgcttgtcacatgcacattaaaatggtgaacatgcaatcttttagggaggtgaatagtggcaggtgtctattcttcctctaaatcctgcccaggagactgccttgcctgggcataacccagcagatgaagtcatctacctctcctggccaccatcatctgattaagggaattcagactacatgctttagatggtgaacatctcacaaaagggatatgttatcagagataaagtgtatgaattccacgtatgaccactgcatcatttgtgaatgcttaccgtatatgactgtatgaatgggccacctgcatctcagaatgtttttggaaaaagggattaaatataattgaaagaaacccaagaaagagcaaaaagcaaaggctataaggaatgagtctataaggttttattttttttcttcccctttgagaggtagtcaattcataacctagattcctccctagccgcacagcccaatatggcagccactactcatatgtgactatttaaatttaagtttaagttaaaattaaataaaaaatttattttctcagtcacactagccacatttcaagaatacaacagccacatgagttagtggttgccatactggacagcacagatgtagaacatttctgaaagctctctcagtgctgacctagagctagctttggtattttcatcttttcatgatgcaatacaattgccaaatttcttacttctcatatactcaaagcaacctcttgaaaaaaaattttttttttgagatggagtctcacctcttgaaatgtttttaagattgttacagtataaattctggaaaaggttctagaacaaattacaaaagattgatttctgagtacacattaagggaagctgtgataattagaagccaccaagcattcactaaaattaagttactacacatttacttcagtgactggaataaaaatctaagcttcaatgaaagaaaggaattatttgtttttattgccaaatatttgcagttcttgcacacagtaggtactcaacaaataacttttgaatgactattagagaaataaaattgatatagtcagtttcagttttcatcaagttaaattagaaaagtccttatgctgtcattgaagaaatggttactgggtcgtagggcagttgggtgagttgccaatgagttaaccagtcatgagaagtagctgacgaagagagcatgagacttgaaattagatagggacctaccttcaattcttggctttcacttaacctgtgtaatcccaggcagccatttcacttttctgaatcactgtttcttcatcctcaaattgggcataatagggtgctcatatcaaatatggtgatattaaaagctagcatgaacatagcctggaaggtttctagtagaatgttgtggagtggttcttcacatttagctagccagtgcttctgtctctgacttcagtaaggatatactgattaaatttgtggatgacccaagatggagtaagaatcagaattcagagggaccttagtagacaaaaagataagctgaatacaatccttaaaagtttcatatgggtaaataataattaagaaaactgcaacagtaattgacagaggacatgtagtttaacctcattgtgcaacagacttgtggattaaaaaataatgtcattcactgtgtgatgtggctgccagaatttagattttagcaataggaataaggtatgcagagtagcacatcagaacgcctaggaagttaaaaatgccaatggctgggttattgccagagattaattaattgatgtgggatgcagctttggcattgggatatttcatgcccctcccctgccccgggtgatcctaatttgagaaccactggtttaggctgagggaggtcttgacgatttctgttcgctccacttttacgtagtctattaagttacttgcatggaaaaatgcatgctgcatgtagttccgaatgccccacccaaatcttggagcgtatcaggaagagtgtggggacagtgagtggatggcaattataagagacatgttgaagaaaacaaaaagtttgtcctgaagaagagtaggaagaggtaaccgccttgaacattgcctgcttggtctattttaggaagctgggttcagttcttctctctggtattccagaggatagaaagcagtccactgggtggcagcttcaggagatggatgtagggaagcatttgcttactacagtgctttctagagatggtgggcttgccaggcgctggagatttacaaagacctcacagattttgttgagaatttaaagggacttaaatgtttattggcagattcaacttccagaaggtttcttttcatccctctcctcatctcttactcttttgctttcatccactgccttggccacactggtctcatagatgttatttaagccccgccatgcaccatctcagggtctttgcacttgctgttcttcttggttgaaatacttcacctccagatatctggacaatttcctctcatgtttttgctcagattacaacctttccctggactccttgtccttctttctttttagtgtttctctatccccatctctcttacacacacacgcacagacacagactcacacacacaaatacgcatatatgtgtatgttttcctctaacaaaatataagccccacaagggccaggacttttgtcggatgtgtttgccaatgtatccccagggcaagtatagtgccaggctttcagaaatgctcaagcaataatttgttgttgaatagatctctgggatcttctggttccttggaatttcaccagtggtagcttgaatttcctattcaggcctggacaaacatcctgtaaagaatgccacctaatttgtatctttgaaggatgaatccaataatatgtgggtacagtgaccactttcaagcttttcttctttcttcttttctccccctgcatcaaacaggaacagcatcttctaaaaacaaaactttattcattggtcagcagtttcatgcaaccattgagtgaaatccaatgtggaaaggaaatccaaaactttactgcagtgtaatttgtttcttctgtgttgctttgtgtacagtaaaggtcaataatgcacaggaaagctaggtttaatttctttgatgtgtaaaaattagtgctttgtcatcagttacagtggcaggaggacaaatcactggcacataaagttgttcctgctacataaattacaaatcttgttcggaaaaaaaatactcacatcatcccttgttattttaaaaatgccaacactgataaacagtcagccttggacatgtattaaaatcttcaaattgtactaaaataaatttagccttttaagataacacctcattttaatttcatacatgattaaatccatcaattcaaaggtcttttaagatgtaagttttgaaatcataatagtaccctctaactccctgcgaaaaacttaaacctctttctacttcattaataatgttcttgacagacaaaatttttaaagaaaatcctcagctttgttttgtgtttttgtgtgtttttcttgagaagaggaaattaaattatgatcataaatccctttcatttttagaactagatttttcttttaatcataatccagaggaagtggaaaaagctttgtgaatcaagttttgtatttctaacatgatgacatagtctaaattattgtccaatattcagcaaaatctttatttctatatgtggcagaactgaatattttagtctcagcataaatagtgcctcctcttccctatccaggttgatgactgcttccttgtgactttgcaaacacaacttcttcttattattattatttcaataggatttgggagaaccagtggtgtttggttacatgaatatcttctttagtagtgatttctgagattttagtgcacccatcacccaagcagtgaacactgtacccaatgtgtagtcttttatccctcatccccatcccaccctttctcctgagtccccaaagtccattgtatcattcttacgcctttgcgtcctcatagcttagctcccacgtatgagagagaacatacgatgtttggttttccattcctgaattacttcacttagaatagtagtctccagttctatcctggttgctgtgaatgccattatgttattcctttttatggctgagtagtattctatggtatatatataccacattttctttatcagcttgttggcggatggacatttgggttggttttatattttggcaattgcaaattacgctgctataaacatgcgtgtgcaattttttttttgtataataacttcttttcctctaggtagatacccaggagtggaattgctggatcaaatgatagttctacttttagttctttaaggaatctccacactgttttccatagttgttgtactagtttacattcccaccaagagtgtaaaagtgttcccttttcaccacatccatgccaatatttattattttttgatttttttgattatggccattctgcaaacccaactttgaatagactatcaaaggttggggctggatatggatctgattactcaccctggccccggaggccaccttcaggcagagcagtcctgcagcctttccagaggaggcagcctcctgcccatgtcaaagaccttggaggctagagtatttgcccttctgctctaatcaagatctccttggaaagaaagctcaatcagcaaatctttattgagtaccttccatcagatagattctccagccccaagctggtatggtgaggataactatatctactgtaaaatacctgacctaaagaaacaatgcaacatgtgcatatacaattttaaaagaaaagctgttcaccattttctaaaggaaaaattatatctataatgtatgtattcacatgtttatttttatatatcaacatttatctgctttttctttccatgcctcccctctttccgtcctttcttttcctcctggatacatccattcctgcagcttaattcttattagctaagggttatattgcagatgtatgaattaagagcaaaggctttagaatctggcagatctatgtttgaatcccagctctgccacttcacaaaaagattgttctatttgttattgttactggcacttttattgccatcatttgtagtatagacaataattacttgtgctatttatgtttattagttatttaccatatcaggcactaagggatttgcatgtattttgaatttaatccttgtaacaattatatagtgtaggtagtattatccccattttatggctaaggaaactgccttgagattttaagtaatatgttgcccaaggtcacataataagtatgtaaaggaactgaaactagctttgtgttttgaacctacggagattctctttatcctctgtaaaatggagatactgattcctgccatggtagctagttgggatgattcaatgatatgggatatttcgcatttgcagtttggttccctgcatataacatatgctcacacaggatatggctgttcctgctctgcttctgctacctccttcaaggttgaataatctttctttcttctctcttagctatttcccagcccctcacttaagtttataactatattcttttcatcaacctagaaaaccaaatgaagcctgaagtattgagaactcaggaaatgtttttgaggtcccatgtgattcagtggcaaaggcagagcaggtgcagatgcaaacctctgggctcttagatgtgaaccctctgcctggtgttttatcctagcttgtctctgcagcaaagcaggtgctggagtctgagggggtccttgaggccagcttcccctgggcacagaaatgtgctctccctagaaccatcacatggcgattttcctggcgatcaggggccctaaatggtgaaagggttttggccatacatcactaaaagtgtgttagtaagaggcatgaggccccttgggactggatgtggtggatgtgtcatatcacatatgaagtggcatgatttgatagtgtgccattttctgtctgtaactaaatcaaattctgtggttgaaaaggactcatacataatcttggtgtcctttaacgcagtcatagttcttgtgttaaataagttaggattggagagttgcatttctagacccgaggggagcggttctggatcttgctctggtttcctgagttgctgcagcacccaaccctgagcaattcctgtgactcgtggtggttgttatagagagggtacacagtggtgaatgagaaggaggcttattattgttatctgtaggcaccacttttgcttgaaaatgtgtaatggcaaactcaaaagtagaaatacttattccctattaattgtcttttttgtcataactttttaaaattttttgggttctttgattcaaatttcacaagatctcacctaatatgctggtaaatttcaccagaagtatgaagacagaataaactttcttgaatttttttccctgcaatgtaacagtctgcttctagatgacttcttgaagaattatctacctaatttgtattttttaggagacatcagagacagaaaaaaattcacattaaggaagatatgtgtattatataagtaaatcctctttgcttacagttcttttttaaaacaagcattttatacaaagtaaaataactttagcagtttggttcatttttaaaatatttcatgcctgcatgcatgattaattgagacaatcattccatttaactaatatttgagggcatactatatgccaggaaatggggctactcaggccttcacagatcttgtaatctatcaaccaatacaaacaaataatcaggccattataatttagaggacagtgttttgagggcacatggcaggatgatctaatgctgacttggtggaggacgcaatgacttcctcctgaatgaagtagggtttaagccaggtcctgaaggagagtgagtgttaacctggtggagctgttggggcaggctaggggctttggactagggaatagctcatgtaaatgcctggagtgggcagccagccatggtgttattgtgttcttcttcttctcagagatatttacatgggcaagaacttcagattatacttgattgtgacatttgcactttcaaaaaacattgcaaaactgcctggtgaaaaccatcccagtcttgacaggtgcatagtctgatatttccaaaggtaacagttgtcacataggtggtcctgccctgttgagacacaagcccgttaagcagtttattttcaccccatggccagattggctttggagcaatcaatgcagcctggtgcagcctggagaagagatcctactggataaggtgggaagcctttgtaaatcaaaggttctaagactgctcctactgggaagatagaagtgatgggtggaatggatggataagtataaagaaattctttggttctagaaccctcaatgtaaaaaacattagaggcacacaggtcataatcatgtcgcataatttgattaatttcctaagaaaccttaatactacaaagtcatattgcatcataaacttacgttttatggagcaaagagccctgggcttgggaagggtccacagggtctgggttctagttccaaccacatgccctggggtcaattatttaataacctataatgaagctgtcgtattctatcaccacgacatggatctggttgtgccaaggtagacatttgagattacataccgtaaaataccgtggaaaataactgtggctctcaccagctctagcctctttctgggcttcatagctccccttccccagtgctccctgagaatgtatcattcagaccatcttctgtccttcattcatagtcatagtcccatgcctcagtgattcaacaatcaggctctcttaccctatttttgcttacccttcttttttctttcatttcagatgttcagtaactgaaaacaaaaaaggtttaagtatgataatgaatttttttccacactcaagaatataaacattgaaaagattggcctctttatgctccctacaatgagtgacaggttctgacttaattcaacttaactgtagagattattggcataagagttattaatataaaagtcatgactcaaaaaatatctccactattaaatatcccctgcaaaactttattatccaggtcttggcgtgagctttgattgtgttgaaagaatgaacttgtgtttttggccctgtaatgtgaatgatggacaggagagtgatttttctgttactgggtggtcatcctcttgaacaagaggattctgaaagtttctttttatatatttgtgtatgtattatttttccttttccatttttgattgtagtgaaagttctatctctaagcattaaaaattaaacatttaaaatgtgcttttgcaatggggaaaggactccctatttaataaatagtgctgggataactggctagccataagcagaatagtgaagctggaccccttccttagaaaaatcaactcaagatggattaaagacttatatgcaaaacctaaaactgtaaaagccttggaagataacctaggaaataccattctggacataggacctggcaaagatttcatgatgaagatgccaaaaacaattgcaataaaaacaaaaattgacaaatgggacctaattaaactgaagagcttctgcacagcaaaagaaactatcaacagagtaaagagacaatctacagaatgggagataatatttacaaaccaggcatctgacaaagatctaatattcagtatgtataaggaattttaaaaatttacaagcaatgcttaatgacgagttaatgggtacagcacaccagcatggcacatgtatacatatgtaactaacctgcacattgtgcacatgtaccctaaaacttaaagtataataataaaaaaacaaaaacaaacaaacaaaaaaataatttacaagcaaaaagcaaacagcccctctagaaagtgagcaaaggacatgaacagacagttttcaaaggaagacatgcaaacagctgacaagggatatgaaaaaatgctcaatatcattaatcattagagaatgccaatcaaaaccacaatgagataccatcttgtaccagtcacaatggctattactaaaaagccaaaaaactcagatgctggcaaggttgtggagaaaagggaacacttatacattgtttgtgggagggtaaattagttcagccattgtggaaagcagtggtgattcctcaaagaacttaaaacagaattaccatttgccctaggaatcccattgtatacccaaagaaatataaatcattctaccataaagacacatccatgcatatgtttactgtatcactattcaaaataacaaagacatgggatccacctaaatgcccattgatggtagggtggataaagaaatgtggtacatatacaccatggaatactatgcagccataaaaaagaacaagatcatgtcctttgcagcaacatggatggatctgtaagccattatcctaagaaagcgaactaatgaagaaacaaaaacccgaatactgtatgttctctcttataagtgggagctaaacagtgagaacacataaacgcgaacacaaagagaagaacaacagatactggggcttatttcagagtggaaggtgggaggagagagaggatcgaaaaactacctatcaggtgccattactgtgcttattacctggatgatgaaataatctgtacaccaaaaccctgtgacacacagtttacctatataccaaacctgcacatgtacccctgaacttaaaataaaagttaaaagaaaaaataaaatgtgcttttagaagtatccagaccaggccagagcttgtataaatccatattactatcttgcagttggtcaaagtagttaagaacctgtgtaatagtgttttctgggatgttgcaacaactttctatctttattgcaagggctttctgtcttcctattatactaattaattctttcagtctttcctgattattgatgccatgatgattttttttttaagaatttgatcctgcaaacttttatgcctaaaatctctctagctttactattgcctccagcaggaatttttcacctaagttcatcaattgcagtcaggaaactggtaaactctgagtctttctgcaaacttctgtgtgtagaggatccagagtttgagtcagaccctgaaagctatccttgatcagatttagaatatcctaactctttagtaagaaataaacccgtctagctttacatgcagccaccagccgtgacgtgagactcaccccacactgacctattattcaacatttcctgatgcttccatacttctctgcctttgaacctgatgatcattctacttataatgtcctttcctcatccttagctttgcctgttgaaaccttcaagattttactccagagccaccttgtctggagagattttatttactttgtgaggaacaaaatgctgctcttttatcttttctcctcctttataacactcatcacctctccccactaagtttgtggacaaggaatgtattctgtttatctatgcattcccagcccagaggaaggtactggcccagagtaaatgctcattaaatattgtgaataaatgggcaaaaggatagaagacacattctttacttagatggagttgagataaacttagagagttagtgctagaatcaacattgccttcttgcaggcaaatgatttacataatctggacatcaagttgcctgtcccctggatgaggtatctcagtctcctatgttaaataatagtaaattgattctttcttcaacacagagtataacaaatacctctaagtattctaagttttatgaaacaaaagatttctggtgctggagattgattttggtagttataagcttctcaggatatctccaaagagacaaggggcctaggtggatagaaatatttcccttaaatcagcctgataaaaagttctccatggtaaggtagcctttgtcttgtattaaaacgcagttttctcaccaagtgactttggcaggttggtgaatcctttaagaaaaagagatctggtctggagttgtggtcccccggagatttagttgctattgtgatcatctgatgacagcagaaaacccagggggatcagcatggtttatttcagactgcagggatgtcagcctgttattataggagtgggagctacctaggcagatggatgcttcctgatttgtggattgggaacacgaattgagcagcagccaatgcagtgacacttgtaatactcttctgaagccctccttttttttttctgtccactgagaaacagtacccacctgctaatctacaaggcaaagccatccttatttcaaagtgtatttgatgcaacaaaattctttatgctgaaaggctttaaaaggcctctaaatttctagaaatgagatttaatctgatatttgaatcttatgccttatatccaaagaacagtctctccctagtccccatttctatatatagatgcagaaatttcataattggaaacctgtgactttagcttatggcttggtcccttgtgaagaatgtattgtgctttttaagtgatgtgtgtatttgtctgaattagtctatcagaagtttctttttgagaatagccattaatgaagatgagaaacagagctgtgagggacatgaggaggaaaacaaacccattaaagagaggaaagaactccctgccccaaccccaccaacccaatagcatttaaggccaccaaagggaacgttttctgtgttactgtttattcaggagctggcttctaacctgccatatgcttcactctatttagagagcctaggtaatgttctctcattttgtaaggagataatattacttaacctaagagcttgtgcaaaactgggggaaatagttggctaataagttacatgcatccatgagttgcacaatagagatgaaatgatgacaaattgggatgagaggcaatgagtgttgtatgggaactacaggatttaagatttgaaaagaggcattttaagagcccatttttttgctttttctactcagcttaggaccccaattattacttactagcctcatttcactggacttcacccattcacacacctgtcacccaaaatactaccaaatattttctttaatgttatttttgcatttaatcctcatgaaggttaataaagtcttctctctctatgtggtatgaaagcataactgatgactttattggtgcagatatattatggctgcttttgacgtttatgttttccgtccagatagatgaatgattccagtgaaagtaaatcaattgcacccagactgtgggtataaaacaccacgctcagggttttccttcttgtctggcagatagtagagggtgtgaaatattgaaatttgacttaatgctgtatgtttcttctgaaaaagagaatttcctttgactatctcctaaggtacatctgtgattgatatttgccctgtcatttagtgccaatccagggaggggatgccccttttgtggggcctgtttgctctccaagggagccttcatggcttccttcggtctagttggagtaacctgttttttcttctagaggattgaattcaattaacagggattacaaattcagttattaggaatttatcagtgatggcaaatggaattttactggtgtattagtccattcttgcattgctatcaagaaatgcctgagagtgggaaatttataaagaaaagaggtttaattggctcactattctgcaggccgtacgggaagcagagtggcttgtggttctgaggaggcctcaggaaacttcaaatcatgttggaaggcaaagggggaacaggcatcttacatcgcaggagcaggaggaagagagagagttgggggtggggtgccacacctttaaacaaccagatctcacgagagaactcactcactatcacaagaacagaaccaaggggatggtactaaactattcagggaggatccatcccgcctacacacacccatttccaatcacctcctcacctccaacattggggattacaattcgacatgagatttaggtggggacactgattgaaactttatcaactggattcccaacaactggaaacatgagagagtaatttcagtttctaggatgggtttaactggctttcatgataaaaagagaaatatttcttgatccacaagaataaaggtttttgttgttgttgctgctgttttttccaaaagtgatttgagttcctagtgtaaatcaaaaccagacgcaactgtaattgccaattgatggtacaaatggacaggtaaatccaagaagtgtatttcaatttttaaaaagttctgtaccctggaattcccttcttcagcttgccttccacctctgcattcaggagtgctatggccctgatcaatcaaaatgaacactggctgtaaacaaccagcatggtggtggtgctatgcctgaatgtcagccttttctggtcctttgagcaagaattaattgcattctcattaggggtcctgggaacttcagggtcaatctttcttgtggaattgagcacattgttttaaagctatttgtttatttgtccagttcaatttccttctagacagtgaagcacttgagggcagggactgtatttatctacctttgtatctttatcaccaacttggtgcctagcacagagacagttctcagtaaatctttgcaaaataaattaaaattgtagaggatatttagaatttttattctaagataaatgcaaatgtgttattgtgtcaagcactcatctgtatttaaatcccaattactggaatgtattttaacaatagtttagtctgtaccctaacattgactgtgcgaatttctgacttatagtttaaaagtctctagggaagaaaatttcaaaacttcctcgttgctctttttagaagttcaattacagtaataatcagcacctactaactcactgggatatttctagtattatttgctctcatgtgaccatatagcatgtatctcaagtgctgcacaagatttgcagctgtgactgtatggaaagcttgggaaatattgtgctgagctccttttgtaagggatgtggtttctagattctgtgttcagggaaaaaaaagtctaaaacctgcaagtactcatttgtggaacatttaatttcattactttgttagcaaagcgtgtatctggaggtaaacaccaatcagctacagttggcttcaggcccaagagaattgaggttaggagtcaagacagaaagatggctattgcaggaaaatacgtctgctctagactaggataaattttcctattgaaatatgaaatagaccattacacagaagtttgcctaccactaaaagtgttctagaacattatagttcaagggtgccaaattttaagcaaagtcctgtggtttcagtgatgctattttcaaatcatgattcctgtaagaacaatctctgccactaaagtgtagctttctctcacacacttattcatatattctggctgtcctctgtcttccactaatctgagaagtttatggcacaaatctgattcttttccttaaatacttgcattaggttaattcttaggtggcccagtaaccttgcgaagaaagatcagtttggggcaaaccatgtgaagccccctttcaaattcatttctgccctactttctgtctgctttaatccaccacatttccttgtctattttgtactctaggtcaaaccacagcagcacattttaaaacctggtaggaagcgggtctcagagctctagaggaactattatgccagtcttacaaattattttttaattatcggtttctcagacaactcacttggtttactttcaggaaaaatgttatcgctgtaaatgagttgtactttcttctgtcagaaaacataaagtgtgtaaccccttttattttagctgagtgtgaatttttagattcaaattgtttgccatgtatttcttagtttgtaaatttgaaatgaagcaacataaacaacggtttctgcccggagaaggtcatgccagtcaggaccctgcgcattgatggtcatcttcaggtgattaacgttgatagatatctgagcagagaatagtgcaggatggagaaggagccacccacagacagggtttagcacattcagagtagactcaccaggctaatgctcatgggcccgctctggtttcatttagggctgagagactgattatatgaatggacaatggccagaccctatatgaaaacagaaccctgacccacaacctgcagcaacccgcccaggaaactgactccttattctcaataaagaacccagaaagctagcctgccatgagttagacttgtaacaagtcagattgcaatctccagtaaccatctaggaagctaaacaataacttcaacaattgacctcaagtggccaggacttgatcaataactggcagcttccctaattttgtgtccccatttttaacttaggatgaacgagagacagccaaataacacacccctaacaaatcagacaggatgccccacttcctgttagaccacctacagcttccctgcacccataacctttaattagggcacatctgaaaccttcctttttttcaggataaagctttcccacttctcttcctgcctttgtgtctccgccaaaatgcaagtgacagtgtggctgactccctgcctctagcaagctcagaataaatagcctttgcttgttctcatttggttggtctttgtttatttccagagggcctagttgggcaagaaatgatattgtccaggagcacgttttaatttcatggtctctgtaggtaggtgattccatgtagctgttgttccttcaggtacattagcatttcctagctttggggtgggggctgtggctgacctgtgagagatgcagccttgctcccacttgctgttccacgtgtggaaagggcagagcagtaaagcacattgctaaatgtcaacgcatgcattaggtattaccatctcacggtgaaccccattcacatggcgcccagtagggaggagcagaggggcctctttgcaacagagatcaatggccaacagcttttctttttttaaaatgtaaaactataaaggaaaaccttttcaaacattatcctcaaaagatttggaaataggagatctgagattagtgggtcactgaagggctagcacttgcttatagatgacttagcttagaaactccaacttcctcatacttttgtttctgctgataatagaatgcagtacaacaggagtgaaaaacaaagccaaattatttctttatctttttctaatgaaaattcaatgacatttcagcagtgacttcttcccaaaccttaaggagtacatataagcgttaagatgagaagttgaccaattgcctaagaacagtttgaagcatatcacaccttattttgttattatatttggtttctactacgtagagttcattatctgtgttctctctgttattactatatttgagaattgtaattatggagctttaataggatgaaagaaaagaaggatgcaaaaatacttaaatactgttcatgatgaaagatctacattattttcaaattatcttttattttattagctgagtttttagggtcctatggcaatatactagagtccaagtattttttcaaagtaatttaattttatgttgttatgattaggtaagtctactgaattgaatcaatttataggaaaagtatgagattagtattattaaatttcatactgtagtctggtttgctttaatatacctatatatgtatgtgtgtgtttatttaagactttagttgtgaaatatagactcctgttagtaactgatgccttttccttttctctttgattagaagaaatacattagaaaggtatcagaatcaactcatttgccagttggcaaacattcctggaattttaagaattgtaacaacaataaaacaataactgtttattaagtgcttactatgtgcactgtccttagtgctttacttctgttattttaagtgttagattatttatagagatcacagtaataatcctttcattgtttatgcacgcacatttgcaatgtaaatttgctgtctgccccacctccttctgtgagggaagtctattttccccttctctgaatctggtctggccctttgactttctatggtgaataaactgtggtgaaggtgatattttgcaagacaaggccttgggagacactgctgctttctctctcagcttcttggaacccagagctgggatgaatgaccatggagggaagaggctcagccacagaactagcacaaccccttgatatgcaagcgaggccatcttgaacaagccaggtccagctgagctaacagatggctacaggcaagacccaaaccaaatggtaccccacagaattataaaccaagcaaatgtttgttttttaaaatttttttttattattttatcgttaattgtagtaaaatacacagaacataaaatttaccatgttaactatttttaagcgtacaattcagcagtattaagtatattcacattgttgtacgattaatctccaaaacgttttcatcttgtagaactgaaactctatacccagtaaacaacaacttctgtttctccctcctgccattccctcacaattaccattttactttctgtttctgtgagcttgactattctagatacctcctcatacaagtgaaatcatgctatatctttatgtgactggcttatttcattaaggataatgtccctcaagttttatccatgttgtagcatatatcagaatatccacctttgtgaggctgaataatatccactataggtatatgtcacttttttttcatccattcatctgtcagtggacacttgtgttgcctttatccaaatggctgttgtaaataatgctgctaaaaacatgggtgtgcagatatctctttgagaccctgctttagattcttgtggatattcccagaagtggaattgccagattatatggtaattctattttttaactttttgaagtgttgttgttttaagccattcataactgaggtgatttgttctgtgtgatagctgaaacacctaactgaattttgacaacaaggcttcgaggtagtttctaccattctcatttttcaagggagaaacttcacttacccaaggtcgtatggtttggacaaacagaaccaggctttgataccatgaagtctggtaccagaacctcactctgcggcacactgtaccactttacagaaagcatgttcagaattgttttacctatagtggttgacgctggacagaaagaaacatcagtaaccaacaatattgaaaagatccctatctatgactgatgtagttcaaggaagtatacttttccagagtttgtagtatttatccattgtatggtggcctctgagcttatttctgtgttgtcagctaggcttaccctggtggtgttggagggaatagtactggatgatctacagggaggtccactcaccccactccagggctgctgggtccagatgggcaaattgggttcgaacaaagggccttgccagagtgggctggaatccagagcccatctggattccactcaggtgggaccaagcctgtgctctggccatctgggagtaaggggtcctttttctaatggatcctccccggaaaggctcctttgtgcaattcatctgaccggagaaggtcctctccttaagtccttcctcttccctcagatagcggggctgttgttgaactgtatcacagctccctgtcctccccatcaccaagtccctgccccttagtgctggatgactgttgtttctcctccatcagggtaacctgtgttgttgaagaagccaccagaaaaaactgtggttgagcaataatgaactcttgacttgagcgttaaagcggggccccagtggtttgcaggagccggtcaagtagagatagaccgagatggagatgagccactgtcagctgagtgtgtaatccaggaggctgtctttacacagtcctgggctttgaagttggagcaactcctggctttaccacctaggaaccatgtgactttggacactgtacttaacctcatcaagtctctgagacacaggtacatgagaaatgcctgccttacaggactgctataggctcaaaaaacaaagtctctaaagggactggaagagaatctattaaatagtcaatgttcgatacatgttcattgttaccacacccattcttcctcattacttccttcacctcctcccaaattcttctacagtaataataatattactattacaactattatcattaaaaccagaggccagtttagttagatttggtggtatctgatatgattcacattaagagagttataatgaagacctgcttgtgattgcaaaggttcacttgcaaagggataggatgaatgggatgtggattagcagcagcattataaaaaactttacaagtttcagttgagaataatctaacatgcttcgacctaaagaagcatacaagtaagcccaaaaacaaggagtagggaagggcatccaccaaccacaaggccaagggaaggcctaggtatctctacaggacagtgaagaattgtgacctatagtttaatccaccacaaagggcatgcactggtatggttggacagtttttaaagcatttatccatcctaaatgggcagtcccaatgcttgattagtagtgccagtgtaatgcctattgttaagtattttgagtagcatcctcattgctaagaacttcatctacagtatatcatttactctttttctttctgcattagtctttatattagatacttatctatgtatttatgtttatttaaataaacttaggggtacaagtgcaattttgttacatggatatattacagtagtggtgaagtctgggaggaaataccatttacttttaacaacaaccatatactttttgtatatataaagcacagatacatgtgcagtatacaaacagatacacagtatatctgtgatattaaaattttatgtgggggagcaattagaaaaaatgtctaaaaagtgtccttagagggacgataatgaaaacatttaagaattactggcaattgatatttttattaaataaatgtgaaaatataggttgagaggttaaataattagtccaagaacataaaattattaggtgtgagagctctgacttatacccaggtttgtgcgataatgaagtgtgtgcttttatccaccttaccaccttgcttccttgcccttcattcagctctctgaacctctgcttccctccatgtgctttactgcttcccatcctcccagatttctctgtaccctcccccggtagtggcctagattctcctaaactgctctgtcccccttctaggatctgagatcccacctctttggtttcattgttagtgaaggaatgcttcaagggaaatttctgctcttgggttggaggaatgagtgtttgcattttaatgcccattcagagacatttctcaaaggactgagtcttttccagtgggacttcaggatctctcacatgccagtgggaagcaatttggaactgtgtgctttgcaaacccgtgcaaatcatagcaggaaggccgatgcctatctctagctaaagccttatgtgctatatatcttcatgtgaatgtctggacaagaatcccctgctcttatgccataacctgggctctacacctgaatttctccatgtagcaattccaagaaaattcaatcttcaaaacacattttttagtaaatagaggcagccatgagaaacattttgttgttgctctgaaaagttgttgttttataaaatggaatagtcaatctcagctttctaaacagagtttctaggatcaatttatcaggaatgagtggattcctttctcttcctcccaaagggtctatggaagatgaagaatacaagcaataatagcaaatcaatcaaatttacattgcaaagagtccttcacaaaagtacctgagagggctctacctagataatcagatgctaacattacctttttcccaaatatagtccacctctgcaaagaaccaaggagtgtgggcttcagcttctctacagagtcgctggtggttaaactcaaagtagcagggcctcacatttgggcactgctgtgtaggaggtgccaagagtcagtcactcagctgatggcctctggtttccaaaggaaaaacaaaaactgttcagagctattgttcaaaaaggaaaaaaggattactccccaaattttagcacccaaaagcatacatgtgagtgtcaagtgctaacatttgcccaagtcaggtctggtggctcatgcctgtaatcccagcactttgggaggctgagacaggaggatcgcttgagcccaaaagttcaagtctagcctgggcagtatggtgagaacccatctctacaaaaaattaaaactattagccacgcgtggtggtgcctgcctgtagtccaagctacttgggcagctaaggtgggaggatcacctgagcctgagagatcgaggctgcagtgatccatgatggtgccactgcactccagcctgggcaacagagcaagatcctgtctcaaaataaataagtaaaataaaatacaataaaatttgcctacattgaatgcctacaaaagccaaggttatttcttaggttatttctctcatttgatataatggataaattcattcaaatgcctcagtttccctatctttaaattgggaatcataggaatacccacctgcaatagtttactagggctatggtaacaaggtgccacaaactgggtgacttaaatgagaaacttactgtgtcacaattctacagactaggcatccgagatcgaagtgtcacagcactgttttctttctcagggctcctggctgtgtgctgggaatctttggtgttcctgatctctgccttcatcttcacatggtgttctcccctgtgtatgcctgtgtcccgtttccccttttaacaatggtaccagtcatgttgggacagggacccatcctactccagtgtgacctcattttgttttttgtttgtttgtttgtttgtttttagacagagtcccactctgttgcccaggctggagtgcaaggatgtgatctcggctcactgcaacctctgcctcccaggctgaagcgactctcttgcctcagccaccatgcctggctaattttttgcgtatttttaatagagacagggtttcgccatgttggccaggctagtcccgaacccctgacctcaggtgatccgcccgcctcggcctcccaaagtgctaggattacaagcctgagctaccgcacccgaccaacctaattttaatataacaaattatatctacaatggccctacttctaaataaggtcagactctgaggtattggggtttaggatttcaacatacgagttttggaagaatacaattcaacccatgacaccacctcacatggtttggtgtggattaaatgagtacaaaaattgctatgtgagggtttgctctaattattattagtaagtagatgtcttaaaggataacaacataagcaatgattactacttgagaacctactaagtgtcagatactatattgtcaaaaacttctaatcctcgtagaaaccttcaaagtgtgttttttatctccagtatcttcagtttacaaatgggtaatctgaagcttagagaggtgaaaagattttgatgtacctgaggcttcacaacttgtttatgattataaacaagactataatctctacttgatggtgaaactctttgaataatggaagaaggttttaaaaattcatacctccttactttagtttttgtgtgcaaatgcaatcttccgtataatgtattgagtttgcataatcaaggttctaaaataattttttagataggaagcttagctatggataaaaactgccaattcaacagataaaagatagtcattttgatcttgtcaataattactttaagacagtggcaggtacctgatttagttaacattcagtgaacagagtccctgaacctgtgctaggaatcccagtccaataaaaccttgctcctgccttcaaagagctcacagttagtttagagagtgtgctaaggggataggccacggggccaggcaagattcacggggccacggtgaggaagattcaggtttatgatgcgggtgtgaaataacttacttgggatcaatgaatcattgaagaattctgttttttatattctccccacccaggcaagagtgcagtggcacaatctttgcttactgcaacatctgtctcttgggttcaagggattctcctgcctcagcctcccaggtagctgggactacagatgcccgccaccacgccgggctaatttttgtgttttcagtaaaggcagtgtttcactgggttggccaggctgatctgaaactcctgacctcaagtgattcacccgccttggcctcaaaatgctgggattacatacgcctggtgtggaattctttaatgcagtgagaggagatgaaggccactttagctaagcctttaggttcattgaagaggccattcaaaaagatgaaaggtttgacatatacttccctatatcaagccatgcctgatttttcagaaataaggtagaagtttaatggatgtcatagtctaaaaatttgtaaggtaatcactataaatggagggaaaaaaacccagttattttctcttagggccatttctcatgggaattcagactagaataaaaggaagttatttataggatgtttaatacccagtccctcaccaggattctagatagaaaaaaaatatttctggagatggaaacgctggtttcagtgtcatgtggaaagttttgttaaacacctatcatgtgcaaaaaatgaatatcttctcgatttagaagagcatatagtctagcagaggaagatagatacttcaaactctccacctcacttgcctggatatgaaatacttcctgcttttgaatgaattacattgatgttgattaatgataatggaataacattactttgcatttggaggatgcttttaacatttcaaagtgctttccgaattatttctcctgtcaaactgtccaacaagcctggtgtggatgggggctgggctgacactggcactggcacagggcccccaggagcctgtcctagctgctacttttctggcaatgcctttcccttgcaatttcttcccagcccgcaccttctaccttttctctctagttcccacactgtgcttcctttgttttggtcttcctggctattgccttggattctctacatatcctgccgtgctctttgaagcaaagctattacagaaatgtaataaataataaatttcatcactcagacagatcaataaaatgcatgataagaagaggccattatggagagtgaaaaatgcgcaagaggatgcccacagcatgagtcaatctttagccaggagatgccaaataccaggcaggccattacggggtattttaagcttttatttgttagtacatccacagacatttgttgagggtatttttcccgctatgcccagggctaggcactggacattccgagacatactgtgtccagaagctcaacaatttagctgaggagatggatgatgcagccataactaattgtaatgcagtgccattgcctctgtagacaataggcagagagcagtgagagttcagagggggaaggaaccagctttggagaggaggggagagggggcttttattaaagcgaggaaattggacttcaattatacagtaagagcaggatttttctcaggtggaagagttgaagtaggtgtgagatagattattttcctcgggcaggaaatatcacatgcaaatatgatggatcctatacttactgacaacgtctagggattttttttggttcacaatttttattcaggtatttaaagtctttctcaatctgggacagtttagataagcagccttacttttccactaagcctgtttcccactaacctttttttttttttttttttaactgtttaaaaggataaggcccagtaagatagaagtgagcacaaaagcaaggggctgctgggctccattggcatagaatataggcagagtgggcttgggccaccagctgtctcctggggttctcaggcctggagtcctgggggagcctcttgtccttttcgcttctctagcctccttgaaggaagaatctgaagggagtgatccagccttattatcatcctggtcacatggagagaaaagatagaagggtgatgctctttcttctaacaccctagtttttgaatatatggcccaagtcagcatccttgaacttgaccagtcagtgacaatactcctcttccgtggaggaagggggaaggatgtggagagaggatgtattaatccattgtgcattgctataaaggaatacctgaagttaagttatttataataaaaaaaaagttttattttggctcgtgattttgcagagtgtacaggaaacaatggtgccagtgtgtgcttttggtcaggacctcaggaagattttactcatggcagaaggcaaagggggagcaggtgtgtcacatggtgagagagggagcaaggggggaagggagaagatgccagactctttaaacaaacagctcttgcatgaacaaacagagcaggaactcactcattactgcaagggaggcaccaagccattcacgagagatcttcccccgtgacccagcacctcccactaggtctacctccaacatcagggatcacatttcaacatgagatttggaggggacaaacatccaaactatatcagaggagcactgaattatatggtacggaaacatcaacttccaaccacaactttgttatgaaattggatacagggctgagataagatgcaaagaaggccctaggctaatagaagtttagtctgttacctccttaatctttttcttctgaattatcctcattcatttactctttattctcacctcccaggcacaatgctttagcctcttttgcatttctgccttttcctattaaggtagccattgataaattaattctggaaaaggagtatgcactttggagtcagaggtgggttcaaatccaagaactattactaacttagcctcatgaccttgaaaaagttgctaggaaaattaaataagataacataggtataatacacagtacagtgtcttgctgtacaagcattcaataaatggcatatatacatatattcactgttagtttttcactagtgatgtggtatgctggaaagaataaaatatgtagtatgatgttttacgtagaactgcttaaaaatgcctgtctcttctcctctttcaggtctctataaagtttctaacttgttttactttttaccagcaattctgtctcacttcctggcagacttatatttagttctctaatgctgaacacaaactgctaactgtccagccaaatccattctcttgttcccctttagtctgatcatgtcttctccatttctcagcctttttatagttaagtgtggccatcagactaagtgttcatgggtatggaatgtaagtagaagtgatgtgtgccatttccagtcttggccattaacttcctacaagcaattctctgtgttcttatcttccttccagacacctgggatggggatgcccggagcaatcttggaagccagtcagctgatctgtccctcagctgagtccctgaatgactgttgagccaattgcctcccacaacatacagatacatttgtgagcaggcacgtgcacacacacagaaacaaaacatttggaaataaactattgccttcaagccatttaatttggggtcattttgttctgtcagtttatcctaccttaatacccatttttatctatctccaagtttgactgagatcgctggaaaaacccaaattgtaaggtacttttgaaagagcactgaaccaaaagcagaactaggtttaagatacttttgcacctaacagctatataatctttttatttacctattcaacccttctctttcttactgaaaaaaaattataataatctctgtgacttagttgagctatttaacttcctggttaccaggttactcacttgcaaaatgtgtcatggaattattgtgcaaaattattaggatagtacatgtcataattttaaatttgtagagtcttctacagcttcactgtccaaaatagtagtcactagccatatgttgctattgagtacctttcttagtctgttttgtgttgctataaaggaatatataaaataggtaatttatacagaagaaaaggtatctttggctcgcaattctgatatctaggaaagttcaaggttgggcatctgatgaggcccacaaactgcttccactcatggtggaaagtgaagcagaaccagtgtgtgcagagatcacatagtgagagaggaagcaagagagaaaagtgggaagtgctaagctcccttaaacaaccagctctagcaggaatgaaaacagtgagaactcactcaccctttcccttccccaggaatggaattaatccattcatgagggattctcctccatgacccaaacacctcccattagtccccatctccaacactggagatgaaatttcaataagagatttggatgggacaaatatccaaactatagcagtacctgaaatgtggatagtctgaattaagatactctgtaagtgtaaaatacaaactgtatttcacaggtctagtacacaaaaagaatatcagatggttcattaaaatttaaaaatattgattacatgttgaaatgataatatcttgagtctagtgggttaataaaatacgttattaaaatgaattccctttttttcacttttagtgtgactaccagaaaatttaagattatgtgtgtgactcacattacatttctattggacagcctgctctagacataaagtattgtaatttagtgcaggcggatatcctctaatacttctgaatgtgagtcttgagtagtaggagttagaaagcaagatttctctaaatgggattgatcatccttactttgcagggctgtaattgggattaaaaatcatatatgcatagtgcctggtacatagaagtcactcagcaaatactagctgttgttctcccaccttttcctttcattccaaaagcagcttccacaatcacaggctatatggctttggatttttctcatttaggaagaaattattttgtttcctcttttaaattcattttttttaaggattggaagaacatttgtaatcacaaaaaaaagagtacactgaggaaaatgagataaaggaaaaccctgggggagaggagtgctggttcctagctgggatgagctagagttggggggaagatcttagcggtcactgcatgctgagtgcatcacgtctgtaacagagctgggagcaagtgttagggtgatgttgccagataccttcttttccttttttttaaaaaaatttactttaagttatgggatacatgtgtagaatgtgcaggtttgttacacaggtatacatgtggcatggtggtttggtgcacctatcaacccatcatctaggtattaagccctgcctgcattaggtatttgtcctaatgctctccctcccctttcccctcaccctgcaacaggccctggtgtgtgatgttcccctccctgtgtccatgtgttctccttgttcactcccacttatgagtgagaacatgttgtgtttggttttttgttcctgttttaggatgctgagaatgatggtttccagcttcatccaagtccctgcaaaggacatgatctcattcttttttatggctgcatagtattccatggtgtgtatgtaccacattttctttatccattccatcatcagtgggcatttgggttggttccaagaatttgctattgtaaatagtgctgcaataagcatacgtgtgcatatgtctttatagtagaatgatttataaatcttttggtatatacccagtaatgggattgctgggtcaaatggtatttcttgttctagatcattgaggaaccatcacactgccttgcacaatggttgaactaatttacattcccaccaacagtgtaaaagtgttcatatttctccacatcctctccagaatctcttgtttcctgactttttagtgatcgccattctgactggtgtgagttggtatctcattgtggttttgatttgcatttctctaatgaccatgataatgagctttttttcatatgtttttgaccacatacatgtcttcttttgagaagtgtcttttcatatccttcgcccactttttgatggggttgtctgtttttttcttgtaaatttgtttaagttccttgtagattctggatattagccctttgtcagatgggtagattgcaaaaattttctcccattctgtatgttgcctgttcactctgacatagtttgttttgccaggcagaagctctttagtttaattagatcccatttgtcaactttggcttttgttgccattgcttttgatgatttagtcatgaagtctttgcccatgcctatgtcctgaatggtactgcctaggttttcttctaggttttttatggtttggggttttacatttaagtctttaattcatcttgagttaatttttgtataaggcataaggaagtggtcaagtttctgttttctgcctatggctagctagttttcccagtacatttattaaataggaaatcctttccccattgcttgtttgtgtcaagtttgttgaagatcagatggttgtagatgtgtggtgttatttctgaggtctctgttctattcctttggtctattcgatttggtaccagtaccatgctgttttggttactgtagccttatagtatagtttgaagtcaggtagcatgatgcctccagctttgctctttttgcttaggattgtcttggctatacaggctcctttttgttccatatgaaatttaaagtagttttttctaattctgtgaagaaagtcaatggtagcttgatggggatggcattgaatctataaattactttgggcagtatggccattttcacaatattgattcttcctatccatgaacatggatttttttttcatttgtttgtgtcctttcttatttctttgagcagtggtttgtagttcttcttgaagaggtccttcttgttccttgtaagttatattcctagatattttattctctttgtagcaattgtgaatgggagtttattcatgatttggttctctgcttgtttattgttggtgtataggaatgctcgtgatttttgcacattgattttgtatcctgagaccttgctgaagttgcttatcagcgtaaggagtttttggggtgagatgatggggttttctaaatatacaatcatgtcatctgcaaacagagacaatttgtcttcctttcttcctatttgaatacactttatttctttttcttgcctaatttccctggccagaacttccaatactatattgaataggaatgatgagagagggcattcttgtcttgtgcccgttttgaaagagaatgcttccaggttttgtccattcagtatgatattggttatggatttgttataaatagcttttattgagatacgttccgtcaatacctagtttattgagagtttttaacatgaagtaatgttgaattttatcaatggcgttttctgcatctattgagataatcatgtggtttttgtcattggttctgtttatgtgatggaatacgtttattgattagcgcatgttgaaccatccttgtattccagggatgaagctgacttgatcacggtggataagttttttgacatgctactggatttgatttgccagtattttactgaggattttcacatcgatgttattcaggcatattggcctgaaattttctttttttgttgtgtctctgccagacacaggatgctggcctcataaaatgtattagggaggagtccctctttttcttttgtttggaatagcttcagaagcaatggtatcagctcctctttgtacctctgatagaattcctctgtggatccatctggtcctgggcttttttggttggtaggctattaattactgcctcaatttcagaacttgttattggtgtatttagagatttgacttcttcctggtttactcttgggagggtgtatgtgtccaggaatttatccatttcttctagattttctagtttatttgtatagaggtgtttataatattgtctgatggtagtttgcatttctgtgggatcagtgggatatcccctttatcatttttgattgtgtctatttgattcttctctcttttcttctttattagtctagctagtggtctatttttgttaatcttttcataaaaacaggtcctggattcattgatttttttgaagggttttttgtaggtctatctccttcagttctgctctgatcttagttatttcctgtcttctgctaggctttgaattcatttgcccttgcttctctagttcttttaattttgatgttagggtatagctttgaggcccttccagctttccaatgtgggcatttaatggtataaatttccctcttaatactactttacctgtgtcccagagattctggtacattgtttctttgttctcattggtttcaaagaacttcttaatttctgccttaattttattatttacccaggagtcattcagaagcaggttgttcactttccatgtagttgtgcagttttgagttctaatttgattgcattgtggttggagagactgttatgatttccattcttttgcttttgcttagaagagttttatttcaaattatgtggtcaattttagaataagtgccatgtggtgctgagaagaatgtatattctgctgatttggagtggagagttctatagttgtttgttaggtccacttgctccagagctgagttgaagtcctgaatattgttattaattttctgtgttgttgatctgtctaatattgacagtggggtgttaaagtctcttactattattgcatggaagtctaagtgtctttgtaagtctctaagaacttgctctatgaatctgggtgctcctatgttgggtgcatgtatatttaggatagttagcttttcttgttccattgatccctttaccattatgtaatgcccttctttgtcttttttgatctttgttggcttaaagcctgtttcttcatagactaggattgcaactcctgcttttttttgggctttccatttgcttggtaaatattcctgcatccctttattttgagcctatgtgtgtctttgcacgtaagattggtcttctggatacagcacaccaatgggtcttgagtctttatccaatttgccagtctgtgtcttttaactggggcacttggctcatttacttttaaggttagtatttttatgtgtgaatttgatcctgtcatcttgatgctagctggttattttgcacattagttgatgcagtttctttatagtgtcattggtttttatattttgatgtatttttgcaatggctggtaccgatttttcctttccatatttagtgcttccttcaggagctcttgatttggctgttgatacttgtgtatgcttcatgaagttctcatgctgtgtttttcagctccatcaggtcatttatgctcctctcaaaactggttattctagttaacagttcctgtaaccttttatcaaggtgcttagcttccttgcattgggttcgaacatgctcttttagctcagaggagtttgttattacccaccttctgaagcctacttctgtcaaatccatctcattctttgtccagttttgtacccttgctggagaggagttgtgaatatttagaggagaagtggaattgtggtttttggaattttcagcattttcgcactggtttttcctcatcttcatggatttatctacctttgatctttgaggctgatgacctttggatggggtttttgtgtgggggtcttttttgttgatgttgttgttgctttctgtttgttagtttttctttaacagtcaggcctctcttctgcaggtctgctgcagtttgctggaggtccactccagaacttgttcacctaggtattaccagtggaggctgcagaacagcaaagattgcttcttactccttcctctggaagctttgtcccagaggggcaccaggctaatgctagccggatctctcctgtatgaggtttctatcgacccctgtcaggaggtctctcacagtcaggagacacaggggtcagggacccacttgaggaggcagtctgtcctttagcagagctggtgcactgtgttgggaaaatcctccttgtcaggatcagctgttctctttagagccggcaggcaggagagattaagtccacagaaactgcggacttaaccacagccacccctccccctaagtgctctgtcccaggaagatgagagttgtatctgtaagcccctgactggggctgctgcatttccttcgaagatgtcttgcccagtgaggtggaatctagagaagcagtctggccacagctgctttgccatgctgtggtgaattcagcccagtccaaaccttccagtgcccttagcactgtcaggggaagacagcccactaaagcctcagtaatggccgatgcccctccccctagcaagctcaatggtcccaggttgactctggactgctgtgctggcagtgagaatttcaagccaatggttcttagcttgctgagctctgtgggagtgggacctgctgagtgagaacacctggctccctggcttcatccccctttccaggggagtggactgttctcctgtctcggtgggtttccagatgccactgggatacgaaaaaactcctgcagctagcttggtgtctgcccaaacagccgcccagttttgtgcctgaaacccagggccctggtggtgtaggctcaccagggaatctcctgatctgcggattgcaaaaatctgtgggaaaagcgtagtacccagggcaggtagcacagtccttcatggcttctcttggctgggcgagggaggtcctctggctccttgcatttcctgggtgaagtgaagccccaccctgcttctgctcactctctgtgggttgcacccactgcctaaccagacccattgagatgaactgggtacctcaactggaaatgcaggaatcaccctccttctgcactggtcttgctgggagctgcagaccagagctgttcctatttgaccatcttggtccctctctcgccagatgccctcttttaaaaattcttaaatgtatttgcagtatcaaagttgagactacttttcttctcctttacagccttttcaatatcaccatctccctaagtatgcagttacaagaggtaacttctctctgtatcttatctaaggaaactgagagcagttagcttctttggtatgaggaaaatgggttcaagtctagcagttcctatttaaagacctttccttagctaatgcttttctttaatcaaatcaccgccccttagattctaaaggaaacaaccattatcctaatttcaggaatgttttatttttctttgtttttggctgaagatccataattttgactgtctaatatgaagcaggtattttccaatacttctctctcagaaccaaatacttgttttctcctcatatctcctcttgtcttctctccttttccttcccttttacctcttccctcttctacccttttccttctttccctttttctttctctcccatttcctcctttccttcttccctctttcttttcctttgtttgttcacgtgacagaggtggaaagaggatgacacattaggaagactgagaaactatcccatttgtggccacctagaaaccagaagttactaagatctagcactaatcaatttcttctcaaagtaccgatttaccttgtattaacatggctttcaagatactctttagactagtgttcccctcttactttctgaatgaagactatttatgttttcacttgaggaggtgaccctgagagattagggtatatagtcataagttacttttttaaattatagctttatagagataaaattcacttactataacattcaccagtttgtagtatgcagttcaatgggttttaatatactcacagcgttgtgcaaacgtctccactctttaattgctttatttcttcaaccttctacaaactaagtatctattaatagacattttcctttgctttcttctcccagaaactgccaatctactttctgtctttataaatttacctactccagacatacattttctataagtggaataatataattgtgacttttgattttttattttaattttgtgattttgtgactgggcttttgtgactggcttctttcacttagcaaaatattttgaggttcattcatattatagcttgtatcaatacttcattctttttattgccacatatattccattctataaagttaccatatcttttttttctacttatcagttatagccgcttttaggatgtcattaataatgttgctatgaacatttatgtacaggttttgtgtatatatgtgtctttaattctcttgggtatatacttaggcttaaaagtgttgcatcatatggtatgtctatgtttaattgccaaactgttttcataagtggctgaatcattttacaatcctaccagaaatgtatgagggaaacaatttctcgacagccttgtcaacacttactattgtccatcttttttattttagcgatgtcagtgactatgaagtgtgtcttgtggttttgatttgcatttttctgttgattaataatgtttaacatcttttcatgtgtttattagccatttgtatataatctttggatgaatgcatattcacattctttgttcatttttgagttgtttgtcttttttaattgttgagttgtaagagtgctttgtatattctgtaatataagttccttatcagatatatgatttgcaagcattttcttccattttatgtttgtcttttcacttccttgatggtatcttttgaagcatgaattttaattttgatgaagcccactttatttatttatttatttgtgtcacttgtactttgggtgacagatctaaggaatcagagcctaatccttagaagtttctctcatgtctttaaaaacacatatacataaaataggatggtttgcaatttctaagcagttcttgtcaggcttcaatggcttccagacaaagttttggctgtgctagcaaagaagtgttaaaatcttattttcatagctagccggtggtgtgaggagggcacagctgctaggcatttggacactgcagcaattgctttaattggacattcctcacccctctagtctgacttgttaatggctttttaagtgagacacaccagccaagtgaattagactatttggcaagtcaattcctgctcacttggaagcgttaatccatggaaagtaagcagaggccttcagccaggaggaaacctgaatttcatttgcagaggtgaaagagaaagaactattgtctgcagtctcaggagtttccaagtacacttccaagggctgactggaagaaaggtcttcttatctaactggctctctctctctctcaaccccactttttcaattcagcacatatttatttttcccttcaacatggctatgaagcatacaagtgaggtctgtcgtggtgcctgccctgtgaagcatctatgcatgagaaacaggagaaaaatacacatacaaaataattagcaataatttgctaataatgtaatctattttctgttcactccttgacttagcatattctgacttcagtcaaccactctacttaaattgttctcttaaaaaacaatgacactcaccagtaacctcttaggtatcaaacttgatgattttcaaaatctgcatttgtagcttcgacctttcttctgggcttcatcctgaatttccccggcctgtcacacatctttacatagaaatcccagcagcacatctttcacacattgaaagtcaaacttctcctaccctttttttttatcgccttttccaccttcaacaatgtattctcctcctctgatcatggctaaacaactactttaattagcaaattctcccattatcacccgcatgtcactagttttagtccatttacgtgacttcctttctattcccactccttcgtgtaaactttctctttcctaaataatacaagttaaggcctcttccacacccaacttctctaatcctttgtctacattttggctagaatcatttttcaaaaccacaaactttatcctgccagttcttttttcacacatcttcagttattcttcagtgcctggagaataaggtcgaaatctttgagctgcttttgtagacctgctcattcttgcctcaacctctctttctagccttgtctcacatagcactaaacccttcactgttctctcctcacatcatggtcatctgtacatccactctctttcctctccctgaaataccctttcttttgactgtttggtaaactcttagtcattctataagttccccaatccaaagtgaacttggaaagtcttccttgagatccacggcaacttgcgtagacttctgttatgattcttatcatacttctttgtgcacaaatttttctcttgctccaatcccttactcttgtctcctctgatgcatttttcaatctcttgctcttgtttattcctttctcaaactctctctacaccatacctccatctataaaccgttctgctcctagataagcagggactgtcctgcctgtgcaccttgcttagtgcctcactcagaagatacgctccttaaagggcctaaggaaggaatttgctgaactaattatgattaaaactatgattaaatctcacccatctaaaggcaaacatgctcaggtttcaaattagtctgaagtgtggtttaaggggctttttaaatgtgacagtttttgttgttgttgttgatagatggtggggagcgttggtatggtgggaaaaaaaccagaaaaaccaaatgtgaggaatttagtgatgcagaattgctgatggagggccagaggccatccctggagtggctcatctgaccctgtatacgatgttcgtttggatgggtggctgtattgtaatagtcacttggacactggctttagaagtcagaagagatttgactcaaggcttttataatatgtctctttcatggtcatctgcctaacttatctgaacttcagaatctactactgttatataaatgacctccccccaaccttgagggttttgtgggaataaataggataatgcttatgttgtgtttagtcaagttctttcatgtggcaagcacttaccaagtgggagctatttcatgtttacgtttaaaaaagtgtgtatctgttatctaaccagcctgggaaaatacagatgatatttctattatattttaccagttcccttgaggatggcccccccttttttttttaaatttcttgggctggggaccaagctctcattcctgaatgctatgagtactgagagagatgtgctgtcaaagccaatgaacggcagttgtacacactgacattttttcagaatttgtccttgggggtatttaagcagcaatgtccaagactgtaaacacagctgagaaatgctgttattacatttaagaatctcttttctgtaatattaagacatcttgatttaattggtaagccgctctgtgatagcattcaatttaaatgaggtttgtcgagtggagaatcataaggcaatctctcatggaccaaggattgctgatgaggtctaccttattgccatgtgtcagaaattaaatcactgtctattatcatgaaccagtcaatcagattctctttttgattagaatgcactagtgggggaggtagagaagtgagaatttaaaagaattttaccacttccatattgtgttgcttacttcatggtattagaaatgctgttggctcactatactagaatattatcaaccagtattttcataggaaacaaaaatatagacatacacacatatatacactaaaagaatggaaatctgaaggaaatagagaggaaaatataattttgtctttaaaaaatcccagaagcccttagactcccatgattaggattatattcaacttatacattcttctgtgtcattcttccttcagtaaattaggaacaactaatatgctctgcctcctttctgaataaggaagtataaatggatgttactgaattccctcaagtcctgggcaaatacactatcacaatgtctttggtttgcatgaagatggaggcgctcatttataatgtgaagcctttcaccgttaaagcttcacgtgaacccgaactgacacagaatcaaagctttcatgagagcaagatggaaagagattatgtcaacacaccccatcccaaaatgttgtaaagtgccagacttcttagggtattccatgacactgctagaatgtttctcatattcagtcacgtagatcattcttttactatttgttttcttttagatgagttcaattggagcctgcccgctatggaaaattattgatgcaattacattaatcctgatcaccatggtgatgtatagttataaaattggcttaaaatactgtaaggcaggaaaactaggcaaccttaactcttttagcacaggtggccctctttgcagagcattctgactttcttagtttccaatattctagcagatggcatgggtagttgggcacaatcaattttcttgcattgcctcacatcttccagtgagattttgcggaagaatggtgtgtgcaccacagatcttgggatcattcaaaggattctcaaagctcctcaatggccaatcagcagtgaagagggaaatggtggtaaatgaggtagaagccctctgtgaatgaagtaatgttctggaaggggctatgcatttggattttcattctggtaattttctctatgaccttggaaaatgactttatttcttcgcttttgcagatggaatgaattataaaaatggttctgtgaaaccttgaaaccataaaatgctatacagatgctaaatatacagaatttagcacgcgattttcctctgttcttaggacagttactatttctagatccaagtggatcagggaagaatagtgctctaatgctctgagaaggaaacgagtgttaagctggatactggtgtgcttagctgcaattaaggaagctgctgtggaattagtgactcacccttcatcaggatggaaaaactgtctcatgccgtgtttttgatttctctcccctattcagtttgtttgaagtctcttttgtgataggagaaaatgacaattactctcctcttgtgtttccatttttggtaagcagtgggcagagtttacattggatgaaatttcaaaagctgtttttatgaaaaatcacttcctctgaacaatgggaaaatggtgagagagagacgatagttggcttttagtctaccaggttcaacctcctgcaaaagctgaattcaagactgccctataggcattgggaatctagttaatgccactatctgcctgtgaatttcctgccttaaactgtctcggattatacattaagctggttttttttcccctataatgtgtcagaaaacaaaaattcaacaaactgagcttacagatctaattggcttttattagtgattcatgaatccgttcgcatcccatctgtgaagcaacaagggcctcttcagggtgtggcagaagagtggttttcataaggcaacttgagcaggaacaatgaaacagcaagtgcaaaaaatgattggttaacatcatattacttcaggttactttccttgtataggctaaagcacaggaggcttccttatcatcctggttcagctagccttctgcgtggtttctgcaaatctctctctctctttttttttttttaaactggcccatttgtaagttcagtttgattatgtggcacctagcacaagtgacaccattctggtttggtctggtctgttagagccaggagcctagtccaaaacattggcatcccataaattttattcaatgaatgtttcctatacccctgtgtcaatttcatctcctacatgaatccatccccctccctttccctggccccttatactaactgagttgtttgcgcttgggaggaatacaaagtattttcaatacatggctagcatgaacaaattatagttaaatgatacattttgtagaaaaagcaatgcacactgaggtcatttgcctgcagatgttaaattatctgcttttttgtgttactatatatgctgtagcacttatccactggtgtaaataagaaagtcaattgaactctctctgtctggagagagagaaaatgagattgagaataaagtcttgcagaggttgcagatggccctgtaaggctgaattcagcccttgcgtatattttgttcagttggtacaaagttaaatttaaatgcagttaagtggctttcaaatgcactttgctacagtccccactgctccttagtgtcttatgccctatatgtttcactactttgttgcctacgtagtttctgaatgaacttgaacttgcaacccctcgtttaaaaacttgttcctgttatgaaactgtgggtgcttatgctaaggacttaatctttctctcttgcgtgggaggaaaggatatctataacagaacaataattgtaaactagaagagtagaaaaaaggatgaaagaaaagggcaatataaaaggcaggaaaagtaggggtataagaaaataaaataaagatcaaatacatttattactatgagagcttctatgcgggaaaaggaaaaacaaagtataataatacaaggcaaccacataattaaataattttttcaaaagactgtcagtggtaacacacacacacacacacacacacacaattaggaaaagctacaaaagagccccaagtctaacttggcaaaattgaaagtatgtgatagttttaaaataaaaattaaaatactttaaactagtttaaaaatatatctctacttcatgtacatctgcactgtttgacatgttataagaagtgctaaattatcttaataatttaagaagaaaagaaaagtaatggtcttccttctctctctccaattctaattccttggaatagtcgtttctaaatagattgcagatatgttcacttttcaacattgcttatataagagaaggcaaggtatttagaatttttcttgatcataacaaaaagacactgaaactcagaggcagcaagaggccccattatgggggcaaagagtagcagtggaaatgaaagtgagttcctgaacaagttgcttccaacagggtaggtgtattttgaagtggcgttgtaagtggcaccctactgcttccatgagtttaaattgtatcaactgaatataaagtataagccaattttaaaatgagaatttgtagaattcatgtgattagattagaggtttttaaaaagtaatatttgaattttgccaggggggtggggtggggtatgtattatgtgttcacgggatgacagcagatatcttcaaggaagtggtttggagtacattaagttctgaacacataaaatgactttttttttttttcctttttggtcttcaggagacttgagaaaacaagtgctgtgtaagttataaacaggatgaatggaatagtgatttcacaggagttagaaaaatactccagtcacaaaagttaaaattagagtaatctgaggcattctcagtactttggataccctgtccacattcagggctactgattatatttccaaagaaacttataaaaccagatgtctagctggcaattggttttgatgaatctccaaatctcagcaatgagaaaatttgacagttgtcagacagcagctagctattacgagtgagccagggaattttcttatctgttacaagtatagaaccattacagggagatactgcatcatagtgtcatgtttataaagaaggcttcagagcacatggtttaatccccaaatttctaagaatgacagttcattttcttggatgttgaaaggtgctttaatacctatacaacatgaagatggttttattatcaccaatcaaaatgtcttggtatttcttaatttaaacaaattcattttataggaattacattgctgagaattcacaccatgacactgacgggacttataatagtggttctaaagcctgcatgtgcgtcagaataatttggggatttgaggtgacttgttaaatgtacagtcactgggtagccccctgtaagattctgatttagtacatttggggtggaatccaggcatctacatttttaaaaagcaccatggccaattctgaatcatggtcgggtttgaaaagcactaagtttgggcaggcctgatttatttcaaagaattttcaagcatatttagttgtgccgttcagtaatagtagcttctcttattactgtgtgtatcccagtaaatctcttccccatttactctttcatcgccccactttgggttcttctgctctgccgccatctatttggcctgtacccactgttcactaatgaaagcccgtagcttctaaaatgggccaagattcacagttgatataagctgagaaagactgacaagttattctgccgaatgatactggaaaaaagaataggatagagggctaatgatgttattttatttttgtccggtatctttacacccttagttgctttttcatttgtcaaatggaatctcatgtggaatctcgctctataaagcagatgaaaaaatgtggacccagtctggctgccagtcctgcccacttggtttccctctgactcagacactggtatcccaggcccctttgtctcatgtgcccctgaaaactgctgtgacatttaagcttttgtgtctcacataaaggcaataagcatattgcaaggttttcttttcttcaggtttcaatactctaacagatatgttctcaaagtagaattagtccttggttaaaatgagtcacatgtaatctaaagtgtttttcctcataaacccatctccagcttttatggtgaaattcaattgtaaaataagatgaggtgttaagtttaatttttttgaagaagacgttcattccataaatatttatcaagcactctctagttatgacataattcagtttctaacgtacagtacacctcttacaaaattgcataatctttaaactgaaaggccaaatatcttcatcaaatactgcttcttcagatctttgcttcctcagctctttaaagaaatgggcacctttggcatggatgggtttatatccagatgataattccagagccatcagggtttcagtttttgctggcaaagaaatcaattttattgctactcgaaggctcccctgggatgaagcaatattggaggaggcaatgcattctagaatgtcaactttcagaggtttggagtttgctcaaaaaataaatgatctctgacttgattaaacttcttttgagttcctactatatataagggcctgtggaagggctgggtaccccggcattgtaagatgtgactgcagccctcaaggggtttgcagtctagctggaaagaaggatctggcaataagaaagcacagtgagcccaaatgaagtgttcagattccacatactacatacagaatgcatcatgtaattgaagaaatagaaatcaccaggttacatggcagacctaaaaaaattcagcaagtctttttgaatgtacttgtgactgtcaacatttacattgtccaaaattttcttgtcaggtgagggcatcaaagaactcttaaacgctttcaaatgtggtgggagcatcttgcttctgtgagaagatttatattctccctaccttctcaattctgtttccctatcttatatgctataaacaaaacctcgctcacgaaaataaaagatgaatgcatgttctgaaagaatacagaatcatgacagctgaaatggtcatggtttcttttaggagatgaaaaaattaaatacacaggtgaaaacattagaatgcaattctctaggttaccatatgcttacaaaaaatcaaaaggagctgcagaaatggaaatttctaatgacagaagaaatcaaacagcagatacagtagagactttagagataaatgggtgtcaatagtggtaagaacacaggttcagaggagatccaatgttccatctaaatcctggttctgtcactgagtgggaatgattacttgatctttctgtgtcctcgtttcatgtgacaatatctatcacatgcagtgttgggtaaaacacttagcataatgcctggcacccagtcaatgtgcaataaatgttggctattatcatcatcaccacctccatcatcatcattctctaataaaagttaagcccttctctctgttgaatacacccatcagttaataccagtggctccttttaaatagcttaaaagcaaccaacattctatagatttcagtggggaagattgtaagtgaaatgggtgttgtgacctttcttgaaaataacccttctctctattagtatataaatgctagtgctgagtacacatactctgaagttgaacttaattaatttggggcagtagcattttcactgttgatgagcttgtatttattttctttggtttacaaagcagctggtgttgtccaaaaatttagaaacccctttccaaaatttaaatgacccccttcattcccttcatttacactgttgttctagaacctgggatgacactctgcagggtgaatggagactggtccctctgtcttcttttccatctctcttgctttagttttgctttcttcttcttctttttctttttctttttctgactgaagcatggaataactggctggtgttcattgagctaatttccttacctgcttcagggcctttgaacccaaagacctgtaggtgatctgtgactatggcaagcaggaagccttggggaccactcttcacatttggagtaatcctggtttgaaaatgtgtgagggaagccaggcaggcagagagcactatgtggctgctgagttagaaaatgctgaaatggaaagatgctggaatagaaaatcaaatgccatttattcattggcctacactttcactagtaccttcctggcagccttaagcgtattctttgtggtggtggccttttgaatgtcaatctgtggaaggacttctgtttttagcaaaggctgatctttaaggcaattaggtaacagttaaagtaatagtccccagttattgaacacttgctatgtacagggtactgtgctcagcactttccactatttcattcaatcacaacaacagccctatgagatagggtattattatcatcagtttgtagttgaggaaattgaggttaagggataagtgacttccccaaggtcacaggaagtaagtcgtggagatgagatatgaacctagcctttctgatttcaaagcttgtgctgttaaccactttgctatacttcctcatgtgtgtttaatagggtccagtttctactgaaaggatattttaattttgtgataaaacaggacaggcctaaaaaattaggtgcagactctgaataaatttaatatatctacccatctctcttattcctcttaagctcactttaaaaaatctctttttaaaaggaggttttctttttaaacctaacaataaaccaaggacatccgtccaagttaataaatatgtgccttttttaaaaaatagaaaaaagtctaattgacaagtaaaaattgtatatatttatagtgtacaatgtgaggttttgatacacacacacacacacacacacacacacacacacacacgctgtgaaatggccaaatcaagcttattaacatattattaactcaggagtttattctttatattatattcttaaaatctaattgctttgctatttttaagtatatagtgttattattaactattatcttcatgatgcacagtaggccacttgaatgtgttcttcctatccaaatgaagtttagcccccctccccacttcaagtatctgtcttttaatggctacataatatagtttggatacattatattcaattagccttttgttgatttggatatgccataatctactcaagcattcctttattgatgggctttcaagttacttccagtttgttgtcagttaagtaaattgtttacttgaaagcttccattgtctgggtctctaccactatgggacccattttgagtgttggtgatgctcacacaacaaggagacacaagcccggagttgagctcctaggtgagagagccatccagtagccattctggtccaagtcctgtccctaccacttacctgccacgtgcctctgcacaagccatctggcctcttttaagtctcagtttcttcataagaaaaatgagaaaaacagtgctgctctcaaagaatgaccatgaggacaaacagaataatgtgcatgcagggctgagcacagaacctggcatgaagcaggtgccaaacagcagagcaactgcattgctggaacccagcagaaacatcctctcactggagcttggatgggagctctctgagggccctaactcccctcttttggcctaatgcattatagggactccgtaaacatttgttaaccaaaaaatgtttggaaaactactactgttctgagcggtatttttcgtttcctttctatatttttattctaacagtcactaaaccacattttgagagtatctggaatggagaacctccagtggtttaaatagttttaccaaggaaatgtttttcacgcggaaagaagactgagatgaaacttatagagaccttgcctcaccctttcatttgccgaaaccatgtatttttgaatctagtgtctgagctcttaaccactaagtcatattgctttaataatgatgatgtgataataggtaccatttattgagcacttactgtgtcccagaaaaatgtgctcagcacgctttaccaatgatcccttaatcatcacagtaatcctgagagaaatataccctcattgtctccatattctatttggggaaatggaggcttaaaaagatttaccaaattttcccaggttagtggaaccagtactccaacccagctctgcctgacaccagtgccactgtgctaattccatggcaggctgtggtgactatgtatttattggactctgttcatatggaaagttgtatgcatacagaaacaggaacatttgctgtaatacttaagggagtgaaagaggaatgtacagaaggctaaaagaggtgagtattgctttgtcaattctaatgtctttctatgatgttgatatttggatcatctaagtaagtgctatgatgaaaataatattcaagaggctggtctggctgtctgtagaatgaggtagatgtagtgaaagctggaatggaggaaagcagctaagaagctattgtagtcgttagacattgaagtaaggaaatgtggaggagaaagatggcagtggaattagagacaaattgacaaacaagcgggtagtaattagaccttcatccaatcacttgtggggagtggggagcatggttcatcatccttcaggatggatctgtccctggagattggaaacatgcacgcacacatttcttacttccacgttcaaaactatggtgagcattcacagctggtatttcacaacctcttggattcatgtttattatatcctggatgaagaagcacttcctttcatctgaggctcactgggcccagggttgtgtggtgacctaaaggccgtatctatgaggattttgtctaagagtacctcaggtaagggctctcaggaacagcttcttagctgagccaccatgctccagatttgatctttaatcttatgactatagagaatgaatattttcaggtgactcagttcagtctctacctcatgaaaattaaattgaaaaaacaatatagagattatagttcaagtcctctgctactgtttaactgtgtaaacttgggtgaatgatttaatctctgtcagcttcagtttcctcatattagcatgggatggtccttgtaagatactatgttggttaaatgggcccacgcatgcaaagcacctatagtgcttgggacactgccaatacctaataaatattatatgctaatatttttatgattgaactataaatcataactaccttatgtaatatttttttatatgggtatcaagtctaaaacctccatatcaagagctttctgagccctttttgtcacctcgtctttcccctaccccaattcttgtgttgaggttattgggaaactgcactgttaatcagaaggtagctcagttaagtgtggactcaacgaagaaagaagatcattgagatgtgtaatattgaagacctgggaaagtgacaaaatatttatatcctacaatagcagaagcctttatgtcaatggaattgatttggtttctcagctccactgtctcattcttttggagacttctgggtaaacacattttgctcctctgaacactgtatttctcgaatgttcctccctggcagtcgccatgttctttctgtgaatttgttagaatcacttattaaaccaaagtcagggtcaccccttgtggggcttagaagtgcttttttttttttaagccttttatctgttgatgagctttcgtttctgaatatgaatggtatttggtcaaggtaggaagaggtttgaactagaacaacaactaaaaggcactggatggacaaatcatatttaaatgtaacggctgtaatcagggaagttgaaatagggagataagagaggttatccaaagttctgtgttggttggataagacattcaccgttattattttgtacaatatacagaaacaattgtctactcatacagctggaaggagccatggagattacctctattccccacattttacagatgaggaaacttctcagcgagtagataatagcctgaaattctattacttagagcaagcagggaaagtgttaggagggagttggggttagctctaggcagccacatcagcataatagtagtggcttcaatttttcttcatattgcactgaattcatttgtagtaatgaacctatctgtctatctatattatagtcatcaaattatcttcagtaactatgtaggtgttattagtttaaacctttaagacccatgaaaatacttgggttcaccaagcacgtctgccatatgcacttaaggagattcttcactgaatagtaattgtagtaactgctgccctgctcttgtaatatcttctataaaaataataatttgcacttcaaatgtctctttctgtgaggtgctcggcgtaccttgcaggaatcgcttacctaaatctatccttcaaggtggtgtatggaatagcttccagtggagtagctcagtaggaggagggaagagtgctgagaattcctagaatgcaaacctaaacctgggtttgttcagacataatccttagttatcacattagaataacaccttatattttcaaagctctttcatacttattgaattaatagagccattaaacctctctgaaatagtagtagtggatagtgtgacaggtgattaaaaccagatggagaagccttttttgaccctaacaacaccaaactgattagtgataaagccatacttcaagatgcttgactgtaactctagtgctcttttttttttttttttaactagattatattagctagagatttttcttgataagacagtggtacttttaaggcctttattcctctggattacaaaaaagtaagttacctattcctgattatatgaagcaagttaactgtttcaggaacatcaagagacctttaccacatcacaataaaactcaaggtcattttgctccaggagtacttatacaggtgatatttgacggtagtacatatcttgaagagaaaaaaagtcattttggctagggtaagcacagctaaagtttgacacggcagcttcaatgaatcatgcctctttttatggcacaattaaattttttgagaccaactgtgattttatcagctatccaggtcatctgtaggcaggtcatgattgttacatggggtggtgataattggtacaaggtcatgccctaagcatgttatagactagtagcccagcattgctaatcattttaaatcaagactacaaaattcaactgtagcatttcacttcagagcaaaaacattgcatttgcttgttcatgttgctatttcccttcccctccatgtctttctctccccaattctctcaatttgataggctgtaagaagcttcgtacccaccaaatgcaaccatatttcccctcagctctttattacaaacatgcacttttatcaaaaattttttaaaagactgaaaatgagactcagaatcttttatttatcacagaatggaccctggctcagctgcttattgactgcgtaaccttgtttgaatcagtttccgtacttagaaaataaggaaagtaatacttgcctcatagagtaattgtaaggattaaatgaatatataaaatctcaagcttagggtctagaacgtagtattttttcataaatgtaagtctctgtgtttctcaaatagttgtgtgcataggtatcacctacattgcttgtgaaagcttcagattcttgtgctcattcccgctccctaaggattttggtgcataggactggttaggacctaggaatctgcagctgcacaggtagatggtctgaggattatagttagaagtgccatgctgtaggttcaaagcaaatgggctgtataacacattcttcataaatttctgggttatggtcaaatttcctacgtttttcagagaaagaaattatagtgttcagggggcacttaactggaaataggtagcaacagaaaactggatgttgttgaatttatttattaattcaccgtatgttattgggcaccttctctttggcaaactttcccatagctgcagggaacacagtgataaacgaggtagagatggaggcagagcactaagtgagtaactccttttcctgggagcccagggctctattacccagggtatgctgtcttcagcataaggatgactctatcaagtaggtctgtagatacttccaagtctttactgccgaaactctcgcccttgccctagaaaggtgttgggtctcaaagggagttgtctcagaggaagggcaacctgcagcctttattttattgggaccagacccagcatccctggctcagattcagatttactgttcttatcatcagatgtggaataaaggcttctggaacagcagatgtggttttctacctatgaaagtaacattctctaaagcctagaggatggaacttgatctctagggataaaagagcaacagttgctcttaggatcttgtctaacaattggcttagtaggtgctaactccaattctcatctacctgctccatcttgattttagccacccatctaagcttccacttgccaccctttctgtgattatgccagccaccgactgtgctctctttggtccctcttggggcagagacaatccagaatgttgggaattacctgaactctcatctcatttgtctctccagccatgtgttaggctctgtggccacccacaatctcaggcccagctgttctgtaggaccagccctaagtggcccagagaaatattttctttgggttatatccagtaaaaggatatgcggatatgctcgggtcttgttgagaggcagcctggtaaatggagtgaaaacactagaagcaggcaatgccaatgtgaagtccctctgctccagccagcttcccaaccttggccaagtgcccactttctcaggagtatcccacctcccttccagaccagaaatgccgtagggcttgacagccaatttgcgctctctttcctacatcctgacctctttgactcaggtcccggaacttttgatccgcaattatgaatctcaatatacaaccccttgatcatgaccccttgcctcatggaactctctgtctcctctgtctagcccctgctaagcttcgtggactttgtcactaatctacttcacctatggtcttgctaagttgcttcctctgtcacctcccttcccagcccactcgagctctgtcctgccactgtccaaagtcaaaagaggcagaactaccttccttactttattttctttctcctctactttgctctttctttctctttaccagaacagagcatctgcaaccactctcactgcatttttttaccacgttttcttcagagtctatctgaaaatgaaatacagatttttttgataaatatattttcatactgaggttgaataagaatctgatctttatgattcttagacttgaaaaaatatatattttctgaaggaagtagactgttatcttcattatcacctccgtaaaattgcaaatggtcaaaaccataaaaaatggctttgctctatgtgtaataggcaaatgaagggaattcatggcaactgaaacccttgctttaaagtcagctctttgtgaatggaaagcagctgatattctgtaaatcctccccagatagggtttcttacagaaatactggcagactctctaatgactgtgactgctttgatatgaggatgtggtcaatatctcaagaaaaaagactgcaactttctaccttctgcagtatagagaagagaaaaggaagtatatgatgttctcacatccatctaactgagcaaccaaaatgctttataattttttaattgatttgtctggaaagagtccgttccctataggactcacagatctccatttatgtagggaagaaaattgtagtcctatccccatggctgcttgaaattccattattgatgtgatgagctctttgttcctcattttgatacagataagatattgaactgaagaaaatgcacaaaatatatctttctccactaataaaccgagaagtggtagtggtgccgtttgttaatttgggatttattttgctttgccaaatggatttgccattaatttcactaaggccacacaaaactctacatcagtgacatgcagaaatagaggtgagattgtccagtaagtagttgccagaatttgtcttgatgatgcttgatgcagatttaagagagagaaagcagatgcagtgtgtttcactggggtgccagagccagggggactgagactgccacaatgtgtgggacctttcctttctgagcacagcctggtggcagtcagcctttccctccagcccccacacaaaacaagtcggtcaagccatgcacgagtgatcttgatttgaagagagagaaagaaatttgatccccaagtctcagagctgaggtacttatgcactgaactccaagaggcatttcatttctaactagcttagaatttcccacagtttgacagcaacccaaataaagaaaatacttgaggaagcaaagtagatgtgctggaagttgagggcattacctgatggctgaatgaatttgacaggcttttctcctgttgttttgacacaattgtattttcctctacaccgctgatggagtgctctgcctaaccacgatgtacccaccttccgtggctcagctgagggccactttgtcaaatatctccatcttactcattcctcgccgtggccctctcccaccagggacctcccagatcactctgtcacccccaagactacacatttcggcactttatgccgccttgtcttaccctttttttcatgttttattgctgcatggcatttaatgttattactacagcaaaactgtatttccctagagggagggaatttgacttgttctggtctcaaactctaaactccggtcagttgtgaagaagcctggaaccaaatttgcagcccatctccaggaaagtgtatataattgtgtggtggatactgtgggtcatgaccctactcacggctctatctaattgtttcttctccctcttcccccttcctccttgttgtcagtcttttctaagtttctttcaatccttttagggattgtatggagtataaataaccttccatatgctaagccagaagttaccaacatgggtgtttcctgacgccaggcaagtaatgtaatataatgactcagccaagggaagagggcagggcttatctctgcacagctgcagtcacttgtggccatgctggaatgagggccctttgttgccaaattttcagatttttcaagagaagttagaaatacagagtcttaggcaaacttcacaatatttaaacatagacagctaaagtatgggaatatccttggtgattcccctaacctggaaaacatatttgggtgccatattcagtttgtgcaccaccggtttgcacaacctgctttaaagtttcatttggtaggtatccagttataatggaactgactctcctactgtggctttcttagtataaggccacatgccatgtgctgatcagcaaacgctgttgaaggattttgaaaagactggaaaaaagaaaactggttgtctagttatctgaagaccctgggctgtgtcacatccactatgaatacaccctccaaaatctgagaccttgttaatgagccctgtcttctctcccagattctaactgctcttcagcgttgtgacttagaggggatgccgtaatgcatgtgtgcctggaacccagggaggcagaggtcctctttttcaccctaatgtgaagcatgaagttagaatcatctctgtgctccctaatagagcctcatgcagagctgttatcattctggataagggattcatgggcatttgcatccataccccccaaatagtggttcctgagaaaatttctctgacatgctgagaaaaaataaagaattcataaagttgaaattattgaacttattttgatattaatgtacttttttactctggttgtcccaaaatatctcattgggtatatttacttgacaaaatgaaaagttggcaactggccaggcacggtggctcacatctgtaatcctagcactttgggaggccaaagctggtggatcccctgaggtcaggagttcaagaccagcttggccaacatggtgaaatcccgactctgctaaaagtataaaaataagccaggcatggtggcaggtgcctgtaatcccagctactcaggacgctgaggcaggagaattgcttgaacctgggaggcggaggttgcagtgagccgagatcgcaccactgcactccagcctaggtgacaagagtgaaactctgtctcaaaaaaaaaaaaaaaaaaaaaaaaaagttggcaaccttagaacagttcctgtcatctctctttattgtttcatttctaaaagagtttcatttggttgctacccagttataatgaaactgaaatccacagtggtctgtgaaatccaagtctgtggccagatttgagccacaccctcagttaatgacagggccgggagagggagggaagggtggaaatgaccaggaacaccaggtacagatagaaaatgtccatcctcagtaagacgggtcacctctgtgaggggtacgtgtcctcattcagtccatactcaaaagagatgtatccaaaagctgttgtaagcagctcaggttttgggggcaggggctgaccttttctagtctttgaaagataatgtattactcttgagaaatgtagaattttattgtcagtgtgcttgaattcagcaaacagacccggagatgaacccaagggacaacgggctcaaagaacatagatgataccatggaactttgacctatttcatatgagcattcctgggcctgcatttgggactggctgccttgtttgttttataaattgatcctcatattgattccttacttgatggctgtggaaaagaagtctccttcttgtttgaactcatgtctttgtgagctgcctttatgcttattacataaaagtctccctgattcttgttgatttggcaagagacttccttgctgagaattttgcgggctgtggtatgggtgtaaagtggtttgctgtaatggaacagcttccagaagagaatccggtctccgttttgaaatgccacttcttggaaccagaagaatttattctaggagggagaaaagaattattgataagttcataattattcacaattatttattgagtacccactctataccaggttgtattttagacactagggctatagtaaccactaagcaaaatgcacagaaatgcttgtcttcagtggtcctatgctttattgggacaaaacagatcagaaacaaaataaaactcacaacatataagaacattacatagtatgtgagaaggagacaattctatctggaaagtctagcagagcaagtgtgatcaagagtttacaagaagggattgctgtttaaaccagggaagtcagattaggtgtccttgattaagtgatagttgagtgacagtgacaactttatttatgctttagaaagactactctggctgctttgggaaaagactgctgaaaagcatggagacctgtcaggaacccattgcaaaagtccttgcaggcagcttggagcagggtggtggcagtagaggtggtgagaagaggttagatttgggatgtatttcaaaagcagagccaatgtggatttccaataaactggaccttttaataaagctgagagagactttacagatcatttagaccccttccgaggccaagtaggtagcacaagggagtgaaactagctgcatgacaatagaggctcttagaaacagggtgcattgtcttattacattaaaaaaattaaagccgggcgcggtggctcacgcctgtaatcccagcactttgggagggtgaggtgggtggatcatgaggtcaagagattgagatcatcctggccaatatggtgaaatcccaactctactaaaaatacaaaaatcagctgggtgtggtggtgggcgcctgtagtcccagctacttcggaggctgaggcaggagaatcgcttgaacccaggtcgaggttgcagtgagccgagatcgcgccactgcatttcagcctgggtgacagggcaagactcagtctcggaaaaaaaaaaaaaaaaaaaaattaaaacaccgttcaagccaaattatatctgtaaagtcagcctatgaacttctaaactacatcctgtaagaatcaaacccattctttttacagatgagagatacggggtcttacaaagtttattgacttctccaaggtcattagaggcagaatcagaatcgaagcctcaggcttcctcatttgtagttcagagttcattcattccatctgtactcgaaccatgaacagcttttcctccttggtgctgctctgagtggatgccacccatgtagaatattcttttattttcccactggtgtagcgtgatgggtccattttatttttctcttcatctctatcatcaggtgtcatcttttaaaacttgtgagcccttggctgtcccagccacccccaaagaacacccttgggatttactgattggctcacaacagtaattgtgagcaatgaaagaataggctaacttagcctcctccctagtttggttgatcacagcagagagaggaagactaacaaagaaggcctatataaaatgggaactgagggctatcttttgcttttggcgtcttgatggatgcctaaggtggatcagtatttgtgtaacataacaggggtactttacctgtggggagaggagtgaccactgaaaacactgttcaaaggggtcattcatagtcgtgcatttataaatttttttaaaaatagctttcttttcctattataaaagacatgtatcttggtatatagaataatttgatatatttgataaagaaggtattgcctgggaaaggatgttgagaagattagctatccaggggaacattaagttgtattttcattttacattgttgacagaaataaaaaccttcatggattaaaatttaaacagaaaatacttttaaaaactctaaggaaatttaaccaatatttatatagagaaagcttttgaaactttaaaagcaatgaaaaaaataggaaaaaaaaacaagtaagatttatcacatgaaaattaaaacacaaacccagaaaaatattcacaataaatagtgaataaaaagttaacaaccttaatgtgcaaagttatctttttcttggataaaaatcccatggcatcaaatagagctgagaggaagagctcacagttcatgaaagaggaaatacaaatatggcaagtaaacttccaagaaaaggtggaacttcctagtaatcaaagaagacaagttaaactaaaatgaaaaccatttttttttgtttgtcagattggtaaaggttaaataaaatttttaatacgtaaagtcagcaagttaagacagcagacctgtttacatatgcctggtattaacataacgtggcatatcggtctgaaaagcaatatggcaacatgcactgagagccttaagatgctgatattcatcaatccatgaatctcacttttggtagcaatctaaatatccgctcgtaagatgtataagtaatttttgctatagttatgttatggaatgatgtatctggaagtttatttccctccacacatactctgtgccactcctgtgctttatgggagtctattgttaaaaatctcactgcttcatccagtggtaacatgttttatggcccacaggtgagagtcccatttatcacagaaactttggagtatacataaaactaaaagagagaaaaagaccagccataatcacaacattcgaagtcagcatagctaatattttcatattttcctttctaatctttgcaaagtacattcatagttcaagagagttttgcttaggtgtcatctctcaataataaaaacttctcaaactatggatcaattatgcatatgtgcacctgtgggtacattatacatttatatatgattatatataagcaagtttatgtcctattagtctctgaacctttccatcacatcttaaatttttaaagtttttataaaaattctaatttacccttttaaatacatacctgctgtgtgacgggatgttagagaacccaactctgtatctattttaacagcatggtggcttatagcaagcatgggcaatcttttatgactttgcccccaatctctcccaatctcctgtaattcaggcatttcactttgctcaaccttatctctgatcagcctcctcacccattactcatcatttcacatcaggaatccacaagtaagcaattcaagaaccttgaatggaacatgagtgaaagctatttctgcagcctaaaccccttcaatcaatacaagaatgtcagcaattctagagtctaaacttattaaattctcatattatttttaaaatgctagccccagtcctctttgtctgatttctaatctctgaaagaaacagtaaatgcaaacataggtattttaaagagatagggtggaggggggtgcttttccagggtactctcttatcattttcctgacaaacttatgtgatttaacagttactggtaaaacctttcaccaacagtttgttactgtgacagcagaagcactcaaattcagggaatgtcgaacttcatcttgtgaattcagacctggcagaagaccatttcttcactagaagttggaaaaatgtcactctctgagactgcaataaatggagcccagggttctgctttgtgtactgagtgagagaataatagtgtggtgtccctgtagacagagaagctgactatgctctacggagacagtgttttccaagatgtgttaagtgcaattccagcttctcggcttttgatagatgttcctctagaaatgttcattgctcaaaggcatttaggaaaagattcattgcaggactttaatatgctaaggtgcaatatgaatcaataagcacaagttgtagcacacaacatttaaacctgtatgagcatgaaacccttcttcaagggagactagtgttttccaaggcctgctttgggaaattcttcattgggcactttgcttatgtagcagatttgaatcttagtctgtaaactcagatatgcaataaatagaacatttcacatttttgaaatattaaactctgattttgatgtccccatccctcccaggtggcaggaagcttaactttggcccttcttggagttctgcactgacctgttagtaccatgccaaaattctggtcattgcttatctgtcacacttggctagttgccccttgactcagacagggcccaggatccatcctaaggtcttccctcaggatgcttcctgggcaataattgagtctctactggtggggatggggtgtaatctttttttctgtttgccttcctgattctctctccctgtactccaaaagtcttcctgagtatacctagcattaggttttactgttttattttcttaattgatggctagtatttaagaacattatctcccttctgtattatgtattttaaataagagtatttactgtcttgtatatacttgtattgtcttgtatatacttgtcttgtaagagcatttactgtcttgtatatctgaatgggtcacatgtagtgcaagcttcaagactggtttgattcagcggttcaacagtgtcatcaaagtactcgtttcattcttccttaatgttttgtgactgtgatatgacattgaatctgagatctattcctttatgaaggggaaatagctagcatttccaggttttatatttgcaacccacatcttccagtagagagacacaatggctttggacaacttttcagaatgttaaacaatccttctctcgtaatagcttccatcaaacctctactaacatcttattgaccttcattgcatcacataagttaaaattattctgaaatattttatatatgtactatatatatatataacatttaagatatatgaagaaaaatataatgcgatttcatagcccccttttaaacttccttagcaatgcctcctatatcccctgacaggggcaacgtttctttgtgtttatcaatattttgctttcctgtataattttaccctttatgtatacaatcctaaacaatatattttttagtgttgcatgattttagattttgtgataatgatatcatctatgtgtatttcttctgccacttgcctttttgattccacatgatttgtgagattcatccatgctggtggatgaatctatttcttaatttgtactgtgatatagtattccattgtgtgattaagccacagtttacttatctatgtgttgttgataaactgttaagtcggctctagtttgggagtgttaggagtaatgttgccaatcttctcttatacattgttgtgcctgcatggaaggggtgcccaaatgtacatacatatataagaatggcattgccgaatgaaaccatgaacagtctttaatgttactatataatgcaaaattattttccaaaatagaataatattttcaatataagtagaatataagaactcctgtttttccacatctttgccaacacttggttttgtcagcatttaaaaaagttgtcaaattggtgtgtatgaatttatactttacagttcaatttaccattttggcaaatcaattaggctgagaatatttgcatttttaattgatatttttatttcatcttttgtgaaatgtctgtttatgatttttacccattttgattttgtgttgttttcaccttcttaatggatttgtagaagttcttgtatgttctgcttactaatccagggtcagttatacatgttgcaatatcttctcccaatttgcaatgtacattttcactttttgagataaattcttttaataaactaaaaaaataaggtggtcaaattatcaaactattccttatggttgatattttgttgtcttatttttaaaattattttctactccaacctcatatatatttgtgtatgcctatgtgtgtgtgtgtatttacatatgggcttatatatttgggcaatgtggtactgatatatttgggcagtgtggtactgacacaaagacagaccaatgagacacaatggaaagcccagaaatgaatccatgcatatatgtaaatttggtagatgacattacagataactgggaaaagataagtggaaacaattaatttctatattcaaaaaatagatggaataagaccccctccttcataacaggtcaattaaagacatatatgtatatgtttatgtgtatatatatatatatatatatatatatatatatatatatacacacacacatatgtttatgtgtatatatatatatatatatatacacacacacacacacacacacacatttctacatatgtagctgtatatacacgaatatacacatatatgtctttaacttaacgtgaaggaggagtcttatttcatctgtgttttaatatggctaataattgtctcagcatcatttacgtttcccaataatctgtaatggtatctctgtcatctaccaaatttccccatatgcctggatttatttctgggctgtctgtggtgtgcctttggtctgttgtctttgagtcagtaccatattgccactagcttctatacatttacaatgagctttaagtctggttacacaagtctcctcccacattctcacgcctagaccttattcttcaggaatgtcttggtcattcttggccttttgcatttctacagaaattttataataatcttggagatttttaatatttttatgaaatttcattaaatttatagttttggggaagagttggtatctttgtaacattataatgttgagtctttctatctatatttctatccaaatctacttatttagatcttcactgtctttcgtcactataataaatggtatctttcagtatcatgtattctcattattgctaggcattctttttttttttttttgagatggagtctcgctctgtcatcccaggctggagtgcagtggcgcgatctcggctcactgcaagctccgcctcccgggttcacgccattctcctgcctcagcctcccgagtagctgggactacaggggcccgccaccatgcccagctaattttttgtatttttagtagagacggggtttcaccgtgttagacaggatggtctcaatctcctgacctggtgatccgcccatctcggcctcccaaagtactgggattataggctgctaggcattcttttttttaatggatttcagtgtttaaagaattcaagaagagcctttgatatctggttacctctactttttgaggaaaccaaatccctgatgcagagaatgaaagagtttgtctatctgcttgaacggagaagaaaagaaaaataaacagaaaatgttgcaatttgaaagtaattttagtaaatttgcctgccacacctacataatcttatttaatcctcaccacaacgttcgaagttaggtgttatttgtcctattttcatgacaagggaaaccaaggtttaggaaagccaagtaatttactcaaagtcacagagcgaatgtgtttatggtaaagccaggatttaaaatcaggtggatttcacaccaaaatagttctgttcatcgcgtagtactttccctcgggcaagaagaatgttcacaattttctaagcatttgagtacaatgaccggaatggataatcctttctgtagacaattatgtggctctgtctcccctcactaaggtcagcagacatttgatacaactttatccatctcttcttgtcactgttgctggctgagggggccacttggctcccagggaggagattttgcacacctgaggaaacagacagcagacagcaccaacatgcttcccctagactgcatttggacacacacagccaggcaggggaactgaaattgtagagcagcagtctgtgtggagtcattttaatgttttcttaaacagtcagtgatggaaaactttgataacaactcaagtgaaagcttatggctgcgaaaagcctcctctgtggatctgactggaaaggattctctgctgaatatggcttagatgcctgagccccgtgttctttggtaagaaaattaccgcaagtcattcgccatctgtgatcctcaggggtggaatcttttgctggaagacacagttattatcaatcaacctgtgctagccaacaggcctccagagcttcgcgggtggggggaatgttgttacagaagaaacgggaaagaggagcctttgtgggaaagggtggttagtattcttgatggcttgtcagaggcagtagtggccataatcacgtgagtgcagcacttgagctggttcagagctgcagtgcctggagtcgtgtctgccggcagctgccggaggcggaagtggcgtccatggtagccacttcgtcaggagggctcctcaggttttagagccagagcacaactgtgactcctataccaggcacactggacctcaggagccttgctggagtctcctcagaattcacaaaagaaatatgaagaattaggaagaaagttaaaacttagtagagatcctctttatagatgcaacttgagaaacagcgcacagatataggttactcgactggaggagttctgtgtttgtgttttcctattataaagagttcgggagaaagtggggtgcttgctaaccattggttctctctcctgtctctctcctgtcttttctctcatcttgccctttctcttttgccattgccccttttctcatttttcgttctcttatttgttctttccttctccctccacttctccttcgccttttctctcttgcttctttctctgcttcacttcattctccctgttctgtcctctcttccagtcgcccttttttccaacccaccctttgctatgttctgaattagtgattgcctaagtggaaagatggagacagtttcagaaatcctatttattttagttcatcagttgttactgcttactttttgtttgaatatatttggggtatattctcaaaaatatgttgataatggagtacagaaattctggtgactgttactctccaatgtctctcttttcttcctagaactaactactagtcctttccagttcgggtagatggattatatttcttgcatagtactttcagcatttatcatttttggtaaatgaatacctaatgtgccgctagggaagctaaattcatacctatttcagctggggtgagcactgtgaccttctgttacacatacctattgctgccaccagagacagaagattgagttggatgcactatgggtagagacaagggctggtgctacttacttatcagaaaggattcttgtaagaattaaatgaaataatgggcatagaatttagaattaaataatgttatgtgcatggtatgctacaaagatttggattcagacctctttacaaatctcagattcgtcatttactagcatgcaaacttgggcaagtcactttattctacttgaaccttttcttttctataaaatgaggtcaataaataatattcatttacaaattgatcatcaaggcaaatgagataatacatgaaatctcctaaaatagagtagatgctcactgaatatcaccttacttccctccacccaactatgcatttatttatctgtcaaacatttatattatgctcactttatgccatgcactgttctaagagctttataaatttaactcttcaatatcatcatagtcttttgagtacttactattactatctcgttttgcagattggtaagctgaagcaaaggaggtttaataacttgtttaaagcctcatggatagtaagtagcagagccactaactgatatttttgtgccgacaccttaattcaagcttttttctcctttaactgaagatattattgccctgagatattaccttgaaatcgatatagatttttttcttgagtttgcaaattttctctcttagaaggcctgaggaaaaaataacattaaacaaatgcacacttaattatgagttcattttctgtgttaatgtagtaaagaggtgaatgaatgtcataaaatatactctcatttggttccaccctgagagagccgttggattgcagccccagtgcttttcagcagggaagctggccagagatgcctgcagcctgctggggagtgtgtgggtagctcctccagcagtgtgcctgcactcctcatctgcacagagcatgcacagtgttcaaaggcacacagatggggactcaagtggggccaagatcactgggaagagtgtcggaaaatgaaacctggccaacagacagcacccttctgtttaatcagaatgctggagccaggtccagagaataatgactacaaactggctgtgccttgggcctattcagcatcttgttctcattttcaagtgtttggtccttgggaaggtctcaaagttcactttgctactcgattatgctgcctattgaggaattttcaaggcaaagtgaattcatgtgacctggattcattattatttaagattattaacacatttttagaccgaattggcagtaaggaaagggaggaaggaaacatctattgaggtcataccaggtgctgggtgctgtagtgggcacttctatgcatgttagctcaactgacgataccagagaagtggaaattacttcagattgtcatgaaaaagacaaatggagaaggtgggatgcatgaaaaatagacttttaaaattcctaaatcaatgccctcaagtcatctaaaatgattagaaacagtctatagttgtcttttatgaggagacaagaattatatgtgttccttgtttttttctccttctgcttgctgaagagttctggtttcacttgtctagtccttttccttccctttgtcctgccttgagagactggttatattaagcttttgtgaggaatttcaggtgagagggaatggaggaagaaaaaagagacttagggacacatattcatacccatgtgtgtatgtgtatttatgtgatatatgtataattttatatatgtgataaatacatacacattacaaatgcaattatactatacttaatctttcatatgttttaaatccttcaagtttattatgaacatctccccatgtcaacacatttaaaaccacagtatcattattaatattgcctaaaactctatactcagtatatgtcaatacttgattattggatatttaggtagtttccagttttagttttatcaatagtgcagcagtgacatctgaacaaagtcatttaaaatggcaccagttactgtttctcagggatcagctttattgtgatttttcttaaattagaggaatcgcctatatgttcaaactaattttttagattactagaaatattcttgtaacaatgtcttatggagaacccactgtataaaacccatagaagtgtacttccccagccagatgcagtggctcacacttgtaatcccagcactttgggaggccaaggcaggtggatcacttgaggtcaggagttccagaccagcctggccaacatggtgacatcccatctctactaaaaaaaaaaaaaaattcaaaaattagttgggcctggtggcacacacctgtaatcccagctacttgggaggctgaggcagaagaattgcttgagcccgggaggtggaggttgcagtaagctgagatcaagatcacgccactgcactccagcctgggcgacagagctagactgcctcaaaaagaaaaaaaaaagtggtactttcctccatgggttgcctcctgcccctgaacgcccccatccctcagtgacctctgagcttccacagtacccaagagtgctccggaacaatggtaagaccactgagctaggaactagctttgttttgtttgtttgtttgtttctatattattatttgttgatgttacagagtatagaaaattggctttttttctttaaaagaagaaactatgttttctttttttaaaacaactcacattgagctttgctatactactttgttacctgaattggtaatggttttctttttttctatgttataatagaatctttatatttaaataaacttaaatactttcaggcgctgtggtctagagctcactgaaagtgttatgtgtacatgagcaggaccctcaagagccaacctgtgttttttgtctcattaacttggaggaaggcatgaggggtcagggcctacaatatcacttggaaacaaggaatataaagaaaatctggcctgtttggtaaaactgtgcttctccatgtcttgcctcttttgatctcttgcctaagttttgttttgaaaggttaacactattcatcttgtcatgactttaaataatcagattacttttctatgcaacaatgctctgtttttcctaagtttcctatttcttcagtgattctggggtgggatggagagtgaatagaaatacaggcatcaactttagtgttttcattgcaattgttttatttgtgcccctcaagttgaacctctctgaatgagtgtgatcatatatctcacatacttggtgttttttcttcagatgttgggattcaaattgtttggaaatttcacatgttgtaaacctaacttagtgacatcatgtgaccatgtataagggaacctttatcattatgttattaggaacctgatctctttgtcattcatctattttttgccctggcttgttgggattggatcaaaccaatggaaatgccggagaactgagttagaaatgcataggatgttaaaagaacagaaatttatgctttaaagtattactactattagatttgtaagtttaattttttttcctctggtgttaaataaattgctcaaagatctctgacaccagaaggaaattagaaggtaaatgtatgttgataacacagaaggatcagagagggaaatccactagcaaataaaagaaaataggaagagtaagtaagtacatcattgtaagcaaaaactgacaaaaaggaaagtttgaagccagaaacagtcaaaaagttcttctaaaagtaagaaaatgtttatgaggggcacattggacatattttctattctattggggtctggagagataggcaagtatgaatgaacaggtggaatttagttgttttccaaaacttgaacaaacaagaaagggtattttggggtccaattagcaacattaagataaattttatatactggcttcctgggatttgtgccttcaatttacaagttttgctgataaagaagaaaatcaattttattttattctatttcccagggagatagcaaaatgcttgaggattttttttgcaagagactttttaattaggactattatagaaatgagttaaacagccaaatatcaaacctgaaacgatctcctgaggcaagagtgtacatgatcattaggtttggaggcaaactattgttaaggattctcatataaggtatcttagtctccacaagcaaaggtgatcaaatccagttgaacttgcttcacaccatatgccattgtccttcagtcccccaagcagacaaatcaagcttgattacatatgagataccaaggcatccagagaaatgatagtgggtgtaagtcatgccacaatagggtgtggataggtgtttctggatacggagatagatggccacacaatcctgctgccttcacccagccagctctcagcttaagagaggtaggaaatgaggcaaggaaaggaagatctgagcccttcctggagctcagctgcatcctgaggcagatgtttaatggactagaaatgatcacatagagaattccttgtgtctaacctagaactaaagcctgtgagaacacactcttaatttatttccatactgaagccctaaccagaagcttagatctttgcattccaacataagaaagagacaggggttaccaaactaatctgtgagaagtaaaagaatgtgtgaaaaaaataacatgagccccagagtctagagcagaagtggataagatgaccttacctatagtcttctaagctgagacaacaggaggccaggcccctggtcgggaggatggtgtgtgtgtgtgtgtgtgtgtgtgtacatgtgtgtgtaatgtgacttacccattaggcaccataggtgcggtgccttggggccgtggcagttttagggctccacaaaaatgttttaatcttttttaaaatcaagaataaaaaatgaatctaataaaaataatgaatatttattaatgaattcagcatagattatataaacttgccttatgccaatgtagtcctaaaatatgttttcatatttttttctatagaggaaggtactcatgagggcagaagtgactagggccaaaaaagtcattgtgcagctctgacagattgaatgaccatgagagagacacagaatgacaacctcctgatagatagatgcagagagattggcagagaggaacagagacagaacagcgagaaacagatacaggaagatacatgcagagtgagaaacagggacagagagacagagggagatgaaaacagacacacatgcccacacacaaagagagaaacaggcagacacacacccccgcgccccctcccccatctggacccgccccaccaacatcctgacagatacaggaaggcagagagaatgagacagatggagacacaggaaagacatgcagaactagactgacagccataggctaagatgtcacagggaacattctactggaaggaggcagccatcagcttggtcttacttgtttcagcctcccaggatcaaatatgtctgaagagtaacaggcctttccatccactctttatttttagccacagaggaaacagtaagagagaagagggcagatgcttctgtttaccaggattttaattggctacctttggagcctgtgggcctaagctatgactattgtctagaagctttgggagaaaggtaaaaccacagtgtaaaatcacagtggaagcttggagctgaaatgattattgtatcttctctaaccttatacccagtaatgatgtgtttgtaaggccagtggtccaattttttctgcagagtgaacaaaccagtggctcccccactacctccatagagatgttttaacacagacacattctaaacagcaaactacatcggacgccagtctcctataaatgctagagagtaggcctcctcctggcctttatttttccatgttcctggatatatgagagtctcaagagggaggtttgatgccaacccctgcccttgaccttgggcaaccttcttcccctttgtgggtggaatgaggtgccatgacttgttgcttttattcacaaagtgcctcacttgtttatatgaagccaccggcctcatggccatgcctcagccaaaccaactgggaattatgaagattggtttgaggcaggaagtgtcctggctctagacctaggacagctgctttgattgtgagtgcaccaggaaagtgggacaattgaagcatgaggaccttgtcatttaattgaaagtcacagagttccttttcacctgtgtcatctctggaaaactggagagagatgatctatacaagacccagtaagatacacaccatttaaaatgccctacaagaagtcacagtgaaatgaaataatttacaccaaaaggtgtatgttcttcaatcttctctgaattctggacttctgatcttgccagagatagttgttagaagaaattgatgataacttttttaaaaagaaacaagttttaaaactagaactagctcagccttcccttcattcaaggttggataagcagtagtcagtgagaacttgggaaaatagtcttgaagaggaactgtgttcacatgtccttagtcatgaaaatcatttttaggtgaagtgatttctcattttgcacaaatgattatagagtgtgtctgtttgtgaacttggtcataattgctgcccaacatcattatggcgataatttgtttagctaagagaataagagcagttgaagttatttttaagtttgcattttgtcagttgtaggttttcttttttcttcctttttttttttttttttgcatttgatggcaccagctgagtgtgggatggtgcacaaatcccctcagaaatggagttatttggtcacagtaaactgaagcctctccccaaccgccaagataacagcaattactttggattcattttagtaggtgtgaaaagctcatctgtttaaaagatgagtactctggtttatataggatcctctggtagcagcaggttaattaaagaatgattctatcatccctagcctaaatcgcaggcattataaaagccagcctgctttatgactgtcatgtgagaaatgtgcacactgataccccagaatttgagcattgttaaaagttagtccattgggtgtgtttgttcttcacattatccagagcatctgccagtttcttctttcttgattatatgcacctttgcaaacaatagtacagttagcaacactcttctaagtgtgccacatttaatttggggtgagaatacagctttaattccattttacagatgaagaaatggaggcacaaagttgttaagtacctttgtccaaggtcctagagtttgtgagcagcagaaggggtttagcaatcagcctgccttgggagccatgtgcttattacctacaattcactgcccaactgagaagtagcatgggagatcacctctcccactcatctttgagatgctgattcattatttgactaagaggccagactcttctgcttaccaggattttaattggctacctttggagcctgtgggcctaaggtatgactgttgtctagaagctttgggagaaaggtgaaatcactgtaaaatcacagcggaagcttggtgctgaaatgattattgtatcttctccaaccttatacccagtaacgatgtgtttgtaagtccaattttgtgtttgtggtccaattttttcctgcagagtgaaaaaaataatggctcccccaccaccttgatatggatgttttaacactacacattctagacagcaaactacatcagagaccagtctcctcatccctggaggcatcacactgtgtgctgggctctggacaaagtaactagaagtataagttctaagcagtcctcaccactaagtaacttgtggtataagagagggaatggcacacataattgtcaagtcaacccttactgcaaagaagttcagatgggtggtgcaagcagtaactgctgtggaagctcagatgaggaagaaaacaggtctggctgaatggtatgggtctccaagaagagggcaggatgtgtgcttgtctgagtttggggataagattcaattttattctaaaaaaaattgcacttggatgaatagagagaagaacatgccatgtgcagagatgtgagcaggactctgtgaatgtaaaacacaggtgatggtcagagtcagatgggagagctctattttgggagtcctggatgagaggctgaaaagatacccaccgacccatgctctattatagcgagcagaaaaatgaacacattgtggtttgctcatttcatatatgaaagtgtggggctcaaaaatctgattactgtgtatgtcacgtagaaccacacttccccctccaaagtacgtctcatgccattgtatattcacatcttgtctaagaagaaactgtatctctaagtgccataaactccaataaaagcaggtttgttctttcctcccacttgtgttcctgaaacctatgtttataggaccttatgttacttacactttggtgtgttacctttaatctcaacctctatttgctacaaacaccactgaaaggtgacagtttcatgtgggataaactctattgatctctgtctgtaaggcaagatgtttttctcaagcatttttgggcacattttctctgagaggtagcatagggcagtggtcatgagcatagatggaagtcagactgtctgggttctgatcccagccctggcacttattgctaggcaacctatggtatgtacttaacttctctgtgcttccgattactcatgtttttaaagattaaattcaggcaccatgctttaagaagcacctggcacatagtatggaatagttagcttacatcatgggttcccagcaggggtgatagcaccctcaagggggcaaaaagtttaaattcaggaatggtttcattaggaaaacatttgcttagtgaggcttcttgtggggctgaggggtaagagggatgagtggagaggaaaaaagtggtccagaaacccctgggttgcaccaaccccattaagttggacctgatgaagcattgatagaaggaatcccaaaagaggtttacatgttgtacttggaggcccgtaaccaatagagggtttaatcaacaggctttttacctagggcctgatgtaggctccgccttaaggccatcacattcactgcttggttatgtgcacagggagggaaccagtggaagcccaaccccccttccacagggttcttgaagctagtcatgaagggaacagagggaggagggaatgagttgctttgcctgccttgcctgaggtggaaatggctgtgatagatgtggtgtgacctgggcagagtgaatagtaaaagttcacatctacccaggattttctgtttttcagagtagtttcacactcattatctcacaagcactctttctcttttgaaatagtttttagttacacatgtagtaaagaaatgcattcctttgtaagaaattgaagtattactgataaaagtaaaaatgccccatgagccacatctggttccagttccctgctccctccacaggattaacccctgttagcactgtgtgtgtccagcacttgtttctattcatttatgctcaggtaagactattttaaaaagtacactattgctgtgtagatcctttaacactaaggatatcaaactatatgtaattttctacttcaagctttttttaaaatcataatatgtcttggagatggttccataataaaacattcagatctacctcactcctttcaatgactgcatgcccatggaatgaatacctcattatttatttagccatcttactttctggtaaatactgatattgtttctgttttgatttttttaaccacagctacgaatgccacctctttgggtatgtgggtacgtgtctacagctgctcattgaggcagatattatctttacagcaaaggagactgaggctcagagaggtgacacaggcagtgaatagcatgtccaggaccagaagccaggtcttttttgttttaaatccaggtttgatggattttcttccctcattccacagctacctcccacccttatctcatactgggacatttgcatttggcaactgatttcctagcagtaacatccctggggtggccctacatgtcgctgctccttttctcactgtagatgatggatcagctgctgtgtgtccctgaaggaaggcagctttcaggaggtggacagctgtgtgtgaataaaacaggggaggaggggatccacacatacctgtcctgacctatttaccgagcgagctgttgagccaaagcagcaccgtgttatctaaccacagctaaaatttgaaaggtccaactgagaaatgtcaggaggaagtaacacttgaattattaaggaagtaggtactaaaggagatggagaagaataacctatgaaaccggcttgttttgagcaggaaaggaggagatggatgttctaagtgaccgccataacttgaaaataaagtggttcctggggcctactaaatgtttaaatttcagagaatccaagcttctttttgatgagccttcttcagtattttacaacggcatatcgaaagggtttcttaattaaaatccccagcacgttggaggggcgggctgattgaggctgcagtgcctgcaggcagggtgcccacctccatcagccacgccagccgaaggggcatcctgcagctcctctgtcagagggattcctgccggagcacctcctggcagagagcatgaggcccggccaattcaatgtggcctcgctgccccagcccagccgggacactccccaggacccaattagcagattggaaatcgcatccaagtatgttacaatcaccaagttaaagaggaataacagacatgaaagaatcaagtgggaaaagaacattttggatcccgaaagagcaggctgcttgtcggagttctaacgaaccgaaacaaaataagtagtagctccttaagcctcttttctaacactgctgggattggttagtgtagagaaaagcattgaaattgcaaaagaaaaaaatgcttattgttcctatgttcaatttgttatttaatataacttgttttttaggaatttaataaaaaaaaagggagggcatcattaattttacattctgcaagaaaatgaaaaatgatctgctgattagtgatgtgcaatttgttccttgaacatctccagtaatgtgtgaatgtcacattacataacacttataatgattaaaccagaagatgaaataagataggatagatcttgtgttctttccttgactggtggacaactcatctcattaatctctctttggcttgcagccttaaattgaataagccgtgttactgggggagatttatggccaaaagacttagcagcctcactgaggaaatcttatagcaccattttgagagctctccaagataattcttgggatttgtattaattgtagcttgtcataaaacattgcccaaaccagaaatgagcaatgaaccttctcaggaacttaatattacagcaacattgaaaatatgcacttcttgatgttccatctcatgagatgttaaaacattctgagtcccaatttaaaattattatattagaaatggtagcttcagtagagtgggaaatgatagcttcagtagagtgggaaatgatacactgatacacctgggcactgaggaatgtttgtagaaaaccagtgggctttcaatatcacaagggcagtccttcgcagagcagtgagcaggatgtccctatgaaatgtttgtagaaagaatgaaccaactggtaaccatgagtcctctttttaaaatataagttctctttgtggttgaatttctgacacttggtgtataagtaccagtaagtaagattggcttacttgttgcaatttttaaaggaagtgccttgccacagccagaaccagtggcctggaactaaagttgaaaagaggttagatttaataagtcatccaatatatacaagatttccctttagcagtcatcagtaagccttgcttgatgacttattccatttggggtgttcacttcctctcaccgtagcatgtttattactggactctgggctccttgaatgcgattctgtgcccttttctgtagccccacatgtcagttatgcacaggacacactaaatgctcaacaaacactttctgatatataaaaccaaaattattgtttatatgaagtcaaaatctacctccttgaacttccatttggtggacctagttctatcttctgcacaaaaataaacatgtcaactccctcttccctgtgagtattttgaggcttaatcactcctcaagtcttctctgtgccagattaatccctagttccctaaattaattattttcttaagctgccatgtcaatcattttgtgcttcctggtcaactaaaacctcaggtttttcttaagtaatataaaggaaacatttcccctcatcttttattggagtcatgttttccttttaatctttttaactgaatcctacttaccattttcaattttaatgatactgcttaaccaatctttctaccttactgagagtttttcaaatgctgattttgccaataatgctgttaccatggtgttgtatcttttgcagatttgatcaacagtactggcatcagaaaaacacagatgctttggtaggtgtcatcagggtcctcatctctccctatgctggcattgatctatcaccttatgtgatctttagccccatacaaattctcatatggcattagaagtaactttagaaaatattaaatccatttgtcctctctattgatactatacatgaggaaactgagtcccaaagagcccatggccacattactggttaatagaaacactcatattagaactaaggtccaagtgacaccaaaggcaggtgtcctttcctgtttatcatagctgccagtctttatattattcacaaggtcaatgcaagaaacatttaaacatctcgttggaatcccaacatattgtgataggtttcctattacgtgagggttatgtaccactgtcaattagaagataaagcaaagtggtggccttttttatctcttattctaagatcttcagtaaaattccttctgtttctaaatataaagctttaaaacaggctatattgatgttgcgaaagaactggtacattataagtagaagtgtgtgtgtatgtgtgtgagggaggggtatacacatatgcacgtgctttatatcataattaaagagtggaagaaacaggattctttactggtcaatgaaaacttttcagaggaaggcaaactggtcatttatacaaaaccgtttgtggagcatgtagacttcctttgcactcactaagaaagcactctttttaacgagggactatacatttgttcaatgaaaagaaaatagctctttgtaccttgctaacggaattgctaactattcttcagataggagtctcattgttcccactattcagtatttaaatacacataatgtcatgtctttactgccattagtcagtattttcaaagagctctttttattaaatttctgaaacccaggaccaaagaacactttctcttaggtatatattatttgttagaatggaaacaatcaatacattttcagagtcaaaaagcactgggaaacagtttcttttttggtctgagcatattttttattaaaaaaaaaacctttgaaatattttgttttatcagaattgtttgtagggaaaatgtaaacctcactattgtttaactgcagtccaaagaggactatcatattgcacttctaatcaaaaaataaattgaacatagtggtaggcttacagaaagagagagaattagatttgattagattagctttaacctgcccggaataaaactgtctgcctttcctgttatttgtcagtgtttatagcgggtttcatctacaatgctttcactattatttctgggcggtaaaaggcagtcaagcagaaaagacactcataaatgtcagaaaagagtaagtttttttttgcatttcaagggctttgaaggtcaagttcaacccacttaacggaagcagagtgatgggtatgtggtagcatgttgttagctgctgcgtttaggcatataatttatgtgaagttaatgcacttgtccatcactctaagaaagcaaaaggtcctgggaagattctatttattttattcattttgttcaacttttagaaggtaaaataattcaaatttccataatttgtgatggaaaagtcacatgtttaacttgttaacagctgagcagggtagagcactgtaatacttccctgactcttcctgttgtaatttgtttcttcttctgagcagctgccccactccatgctgggcaaaggaagagctctgttaagcatttttgcaaaccagtgggcattttttttttcctctggaagcctttattgagatgttttctttttctttttctctatgaggctttattttttcccaccagggagcctgagcaattatagtttaaagctaccgaagataggtatgttctttgatatcaaagagcttcttgaagatttttcaaactaaagagacccaaaggttgtattttaaggtgttactagcatggccctttgtagttgaaaactctcagaatgtctaccaagtgtattatgctttgtttggaaatgttggacctcggtactattgcatttggtaaaaggcagggtgttagaatctgtgtgtatgtgtgttcctactgctgctcagtggagtctctgtagttgcaaattgtttccctagtgatgtaggatgactagagagagaatagggagtaaggaataaaatcgacatttattgagcactcactatgtgctagaggcataatgtatgtaggggatagaaaatcttatctctattcttttggttttgttcccaccttgaattgaattgacatagacagatcaatgggagaaaaatgtatttaatacaaattttaggtggcacaggatccttcatgaggaaatgaagacccaaagacacagttattgttgaagacttacatactgaactggaaaaggaatagtgagctgtgaaaaagaaaataattatgtggagagactagaagataagacttattttaacaaggttagtacagaattttcttagtctcagcttcctgtccgtgatgataagaatgttgctttctttctactatagggagggatctttcacatgaaatccataggggaatttcacctcctgcttttgggaaacagatggagggtcggagtgatcttgcacctcctattttttaagtgcttttagctcaaaataattatgccaaagtagcatatgtgggggtggtgtgttctgaacgtttttatgcatcttatttctttcaatcctcatttactctgagaaatggcaggttactatcctcatgttcctgattagagaatcagaaagggaaagtttacttgcctttgagtcaaaactggtttctttaacatccatggttgcctcactagaatagtctccagaggggaggaagtggaggaaaaagaatgaaaactaggaaagcaaagcaaacttcttgggaagtgtgtgtgtctgtgtgaaaatacatttttgtgcaatgaaatggtttgagtactgtagctctgagttctttcgtagctttgagaacttttaccactaaatggtagaaattcagttgttctcttttctttctaaggaaatgtctttgggtcaccccattgaggtgctaacttgctgcctctttcctggacttcttttctcccatcgacccttctcttcttctattcgtcaattctcaatctgcaaattcctgttgcctttcatatgtagaaaattcaattctctctttgtttttactgtccatttccagaccatgctttatcttagaaaccccaaatgtccatagcagtgttttactaaacgatgaaccatgaatgtgtatttaaccaatgagtgttgagtgccacctgtatatcagatattatactgggatgacatagtggcaaccaaaacagacacagttccagcccttgtagaatttcaactctgatgagaaagaaaggcattgtgttattttataataaatatattctagtttttcccctttatactttctgctgccatcaactttattattttgggagaaaagattaaatttcaaccctatatcttgtatggtgcagttgccccataaatgtgtgttgattggtgaaaaacatcaaatctctttagccctcatattttcttgtcacaaaagtattactaatattttgtattaaatggtcattgaagaaaatcatcatgtgtagttgagcatcagcattggtcagcatctgtatagaacttgaaagcctataaagggaggacttttatggactttatcagaagcaagcttcataaatctgtggagaaggggctcttctctccattttgcagttgagaaatcagtagataggaactaatttgtccaaggtggagatgagaatctcatctctcctgtctctaaatcatcttttcttttgactatattgtctcttgacaataatttaaaagtatctcaatatccacagcaataattattttttgcctgaaaattacaggagcagattatttcattcatttaatgtattgattcaccaacatctcttgcacatctaatatgtgccaaataataagtttccagagccaggggtatgttgtccttttccttaaggcattgtattctaacttattggggtagacagaaatatgactaaataaatacaggatccttatttaggatatagaaggacacatgacataagtatagaataagatatccttgtggtataatggaaagatcattagctttttaggtgcgcctggtttgaatcttgacatcaccagttactagctgttaatttgagcaaatcattcatctttttaatgaacagttgtctcaactatgaagtgggggataaaggtatttacatacattgtagttgtaaagatcagaggtgatatgtgtacgagacctagcatgatttcagaaacatagtagatgctcaattaatggtactgcaattttatcatgtctattatacagatatataatttgtactgtatctgtttgttttttacctacatatctaaattttcttctctatctatctgtctattcctcaagaatcaagagactaacttcccgaagagacagaagaacagctaggagaagtatcagagaagtaaagtttctagggttgtacaaaaacttaagttttgtacagaaaaaaaaactatactaatatatgtggcaattgaaaagtatggaatttatcaagaaccacaaaaagcttaccatggttaaagtatagggtacaagtttgggaggctgagagatgaggctggaggaacagtcagaggtcagattatgaaggggcttttataacatgttaagacacttggactttatcttgccatatagacaactccctctcacctaagtaggaaatgacaagctggcaattaaagtgcttcaaataacgtatcttagtatgtggaatccttaattgtgtagaaagaggagaaaatctatctaaaaacttacccaagaaaccaacacatggtatatactgaacaagaatccttacgattgatgggcaaaggagaggtgagatttctagtgaaatataaaattagaaagtatcataaaccaaatcccagaagcagcatgcagggctgaaatgttataggccaaagcaccctcgggcaaattttgtccattacatggtaagttctaaagcagcagggacaaggctcagagtaactaaacccggatggaacacctgcagtttttccctgaacgtcagcataaatatttgacatgtcttcctttctgtgaaggggccctgtcccagtgggagtggtgtctggtatcccttagcagaagtatttgttttcttaagcttttctttatgtcctagaggtggattctaaaagtccctaacgtattttgattttgaattttcacaaaagtatttttttctttcacagtaattcagtataaaaggcaataaaagtgatgtatccagaaatattcaggacctgctatcagcaccacatgggaataaactatcttgccacttgcacatcccatgggaaaaaagaatcacaatccacatataggaaatattgcatgtgtttgcctccgttttgcttgtattgtctgctctgctgaaaggcagattttttgcagataaaagctgccctgcgttggtgaactgctcacctattttactcaggaagaaaaggctttgtgaaaatcaggagcaaagcctgatttgcagaataccatctaaaaataaaatgcataaaaatgtcaaaatatgctaagaatacagggccaccttcatgctttgaaaaattacctagcaaattcagcaaatgctgtttttaagtgaatgtaaattatgtgttttcgaagtttcatcttgtgaattggtggctaggtgctgaaggagacatgagggtgtggaggcggcctttctcttcttgctgcactagggcaatagatctgtggttaaagcagatgaactgggaagctcttgatcaggcatacgaaatacccagattcttgtatattttctagtttgtgtgcacaaggcttctggcttggctgcttttgccagtggggaagcattagtgaacaaaacagatacagcttccagttttcaagagctcacagtctagcaagtcactgcaactttaaaaaggggatgtacatgtgtggtttaaagtatggtgggtaaagcctttaggggttgtaaaagttcagtcactggggcctaattctgcaaaagagaaattcttcccaaagctgggatacattgagtgtcttgggcaccagagcagaagttttagttaaaatattaagatccagcacaaagttacctcccaccagttgaatctgtttttgaaatttggaaaaatggcctctgtttctccacaactatgtattggtaattcttccctggggactaacttcatatatatattttcacaataatgcatactgaataaatctgaatattttgcttatggaatcaacaaataatctccagagaaagtttcattatgcagtcatatataagatatgaaacagattttttccctttattttaagaaatatgcatagcataaaaattctcaggctctctttgctttatgtagcaccatttctgataagataccaggtttcaacaaactggctcagtggacatttaaaattcccattgtgagtgccagggcttagtggaagatgtttgaccatgtgcgctaacctatcagtgttcatctacatattgggagactgaacctgatctattctgcacaactggacagaaaaatatggaggtgggttctcagccaagggttaaaaaaggaagtaatctcttttgctgtaaactttttctcagcaggtgtaaaatagctgcaatcaggtaggctttggtaagtggcagctgctatctgcccaattgaaagatcagaaattctcaccctatttctgtttcaattatgtagacagtggctccaattttcaagtgtctaaaggcatgcctaactctgtgataagaaatggatgtgggccagagtgggagccatgtgcaaagctgtgctgcaaaccctttttctagtgataccagctctagacaatcaaggtccctcggttatcattatagagtcattaaactcaggagccagcagtgatcactaaaaaatggatgtacagatgaggaaactgaggcctagagaggttaataatctgacttgtggtcagacagcttgtagacttatctagatatagcctctgtccttaagctgctgcctaaggacagctaagtgctaagtttattgctaagtggtaaactgattagtatcacaaccacctgcaacattatgttgagaggattctgaagttgcatcctgattcaggtggaaatagtgctatgattgattagcaatgtctgcctggggagaaggtgggatatggtttgctgtgtatttgctgaatttggttgaatgatgatggctgctttgtaatcacgattgctacaggatgtgaagtgtgcttcagtcagaacaaagcgctctgaatcttcttggaggggcaggacggtttcacagaggagacaacatttgaatttgatcttgaaggacaagtagaagttttcctgagagagaaagaggaaggaaaggaaagaagacattgcatgaggaaagaatagcttatgtaggcaacctgatatgtggataaaaaaaggaaattgatgatcattgattgtctgctatgtaatgggcactaagctaggccttttctgtgttatctaagtatttaattttcataatgaccctttggttttacagatgaggaatcagagaaaaagaaaattaagatgtctgaggtcattcagctattaagtagagctaagattttaattcttggggcttcaaagtaactttagtggcagcaactcagaggaacagtataggtaaggaagagtggatcagagaggcagagatcattagtttggatttggactattgaacttgagttgcttctgggacatccagattgggatggctaatactgttggaaatctggcacagagtgatctggtgatggtttaaaaaaaaaatcaaaggctctttgataacagaccttgtgcattttacatctaggttcctgcctaatagtggagatgtttctgcctttgctattctagcaggggaaactatacgtaataaatgcatatgctttatattgttttagtgattcaaatgactgtcaatgcaatattaaattcagaattgataggaaaactgtcctacttagaaattcaagagttcttggcacaatactatttattatcaccatgagacctgtgctgtagcaaaactctgcttgtgtttcggtgaaagactgtttaacatgcatgtttcactctaccgaggttcaactttgacctataagaggacagtgtatattccttagagagatgctaggaggtaccacaattgatatctatgtatgagaagtgggtgggatatgcctgcatgagcaacataatctaaaccaagttcaaaaaaagaagttttttttttttccacaggtgcaatcttgacaagaagaaaaatctcaaaaaggtattttgcattggtaaattctgatgtcttgggcagctccaggactgtttgtcatgctttccttatggacttctggttatgcctccttaaggatgtgggctgagggataatcatttaaaatagtccaggcaccatttctgattctttgttccctagaatgatgatggtggtggtggtggtgaccacaacggtgacaacaatgataccaccatatttcattgatttttaaaatgtttttccacattttcagctatctaagaatacttatactcagtacttccttgcagtcactgtcagcctgcaacaaagttaaatttgtccacagaggattggcattatttcacatggtcacctggggtcactaccaacctgagaccatttaaagttatttgctgaggtgttttgtttgtttgttttcgcactgtcagtatgaacttgtatcagaaacctgcatgagtatctgcttgtggttcaagttctcagggaagattatttttcctctttctcttcttgctgtgcctttctgaatggaagctttctttctggcatattctagtgctaagggaatagctgtttggtgtttcagctttttgcagaggtctcttattagactcccatcttacttttctttcttattctatttagagtaacagtgtgactaacaatcgatggtctcttatagctgatgaactactgtaacaataaaagctaacatttacttagcactttccttttaccaggcagtgctctaagggctttttatatgcgataactcatttaaaccttcaataattatattagatgggtactcttattttccccaattttaggtaagaaaacgtatgctgtgtgcccagggttgcacatattgactcacttagtgttaccagtggagggtgtccaggttctgggcgttttgaacaaagaattgcacaaaacacacaaacaaagcaaggaaagaatgaagcaacaaaagcagagacttattgaaaacgaaagtacactccacagggtgggagtggccagagcataaggggctcaagggcctggatgcagaatcttctcaggtccaaataccccctagaggtttcccattagcctgatgtaaatgaagtggtgttcacctcatgtaaatgaagtggtggtctgcaaccagtccgattggttgcagaaagcaaccaatcagaggctgagttacaaaggtcacagtcctatgcaagttttctgcaaccaatcagaggctaaagtgatgttacaaagttacatttctatgcaaacgaagacttggcccacaatcagtctgattggttgcagacagcagttaatcagaggctgaagtgaagtttcataggtcacactcccatgcaagcatctgattggttgcaaaaagcaaccaatcagagatactttccattttcaatctgccacctagaaaaagtggggttttgcaaagggagtggtctctggtccttttgttacctagccagtggaaagttagggtttttctttcaatttagtcctaggaagtcagcgtgaaacggccttaggttccctgcctccagaccctattctcttgcctcattagtgtaacttgaccacctgagtctaccggtacacccctggtgagaatccacttttagctttgtaaagtacttggcataatgcctgatacttgctgagtacatagtgagctgttgcaagtcccttccactaaaaaataagctattgtccttatcagaagaataggatactcttttgttatctatttctcattccatgatataggattctagctttaagtgttgtcaatctcagacaagagttgattatctaaaaaatatggattcttgtaagccttttcattatgtgccatataaaaaatgttgctccaagcaggtttactagtttatcaccattcagatttacaagttctatcaggaacttcaaagcaatttcctagtaaatttcctagtaaaaagtccagtttaacaaatgtttaaatttttctcacttctctttatattttaaatttttctcacttctctttatatttcacaccctaaccctctccctcactttcccattccccaccacattcacctcaaatctacacagaaatcttaaagtgagatgaattaagaaaaaaaaagaaaattgccttttttcttttatgaaaaaacatatttttataataatctgaatctgaaatttttgaaataatttaggacttatatttagaaaaaatcatttaatccctctgtccttccttctttctctccttcattctttcatttcttccacaaatatttactgaatattttctgttaaagacattgtgcttgatactgccttatgagatatatttctcagattttgttcatgtcctgaagaaattttcaaagacaaaattaagggggaatctttctctccttccctcccttcctttctccctccactctccctcttccctctttcctccatcttctttctccatccaccccatcccaccccacccttatccatgaactagaagccaaggaggaacaaatgctttatgggggaaacactctgagcaagttatattggaacttgcagagatgaggatggtagaatacagcaagggggccaggaggagcagcatgaacaaggtcacagtaactggatagcaaaggggctttagagaaggctgagaagtccagcttgaaacatggaggacaggaaagggagagatgggagaggagacttcccttctcacttcacttgttacagagagatgcatgtgaggtgtgaggataaatgccatttaatgtaaggtcatgtagattcacagaaaaataagagattccagctgatgtcattatcatcgtagtcattttcatcattgtcgggatgcctctggcaggacttcctccctaatgacaccaggaccaccagaatttacacttatgctctgcttctgtgtcctgaacaccttggaggtacgaatggattctaagagacaaactcatctcgtttagagtgaaaagatgacaagcagaggttcgcagaagccacatacaaccaatgaagcctataaggtagctgagaattaaacaaaagcacctgttccgattaccttcattgttcctggttagttagcacctccctttcctcaacagaatgcccggcgcacaggggtgggatctgagtgagggcaacaggtggattggagaacatttcttcccataagtagtaggatttgatggaaaaacaagtaacttcagggtaataaaatgatggaaagtcctgatgggtcaggtccatatctaatcttaagaagggcagccttaggcagcatagtgggtgctagaatcattggtaccatcaagaaaagagtagtaatgtgaatttcaaagaagatcactttgggataatgaacagcatgacagaatccgggagcctaatgaagaagatgtgatatagtaaaagaaatatattgagtgtaggctttgaatagggcagaaggagtggaactagagaggcaagaggagatgtgattatggaaggtcttgtatatcataccaagggtctgcacttacactgtagagtccagagggatctaaatgtaggatagacaggatcaggtttgattttggaaagctcagtctggaggtggtgtggccaatgtttgggaagtggtaaagactctttcgggaaagacaatatcaagagcaaacatggactacttcatcaggtatcaccagcagatattaaattatcagtacaaaacccagcaattattactttcagatcggccttttttctcttactaggagaatatagtccagatagagtgtacgtgcatgaataatcatcatagtcttaacagaggatgaagtttaatgagtgttatcagttagagaattatttatataatctcagttttccagacaaagaaatagaggcatagtgagatgaagtgactgcccaaagtcatagatggagaaaatggtaaagatgacttgaactctgatattctgcctctagagcctgtgttctagtgtgtgaattaactaagttgttaattgttattcatactaatgggaacattctcatataactggttcagaaattttaaaaactggtaccagccttaggtagattttgtaatgcagtttgtcagtaaccaaaatacctaattcatatggaaaattaagaggctggtgtgaagcatgataattacatttactttgaaatcagcaatttgtggataaatttaattcattttgcccaactctggctttattcccggtattaaaaagacaactacagggtgcacttggttagcactcagggaaaataaagcaattattcttccacttctgctagagaacactaggtaccctttgacagtcaattgtatagactcttattgtaggcagtttgtaggaaccaacctgatggaatgggtatgtcttcctctttcagctccacaatccaatgacccttttgttcaacaaaaacacaactaaacaacaaaatgttggtagttaaaaaaaagtttaaaagtaataggacgccttcaacatggtaatctactttaagaatttagagcacatgtcagtatgtcaccttcagacatggttatagtccagtaagaattacaaatccaacaaacaaaaatcaaggcaatagagttttcatgggtaccactgtaataaattcttctgtgcaaaaagccagtcctagagaaaaattataggtagcaacattttctgaggaacttttttcccaaaggagtttttttttttggggggcggggggtgcagacattattgagaagttcaagttaacatgagcattatgactgtatcagatgacatgataagaggttacattgaactttctaacacctattcttaaattataataaaaaaactcattgagtttttaacatgcctgtacattttctcattttattcagggagtagatttaggtttttctggcctgactggatttttaaactgctacaagataacataaaaataatcatggctatattcactgagtttgtttcattttgtaaaattatgaaaaacaagtttatctcattcagtctctttagcatattgattcagtatatctccctttatagaaaagaaagaaagcaaggattttcacaagatagagctgaagactgatattgagtacatagaatgaagagcccagaaagcaacgtctctcagtgtggctggacagatagacacaaataaatttcatccaaagggttagttctgattatgagaacatgggagccttgggccttctttacttacccatacccctaacaaattagtggggtttttcctagagttcactatagtttaataagcgggatacacccagatttttgattcaacgatgaaataaaatgaatgaaggttttatttatatactctgtgctttgctacttcaactttgtgcaaatggaaagaagctttattgcattcagagagaattagatttggaacttggtcagtggcacaagatagaactataacatattgatgagacaactttttatgtgggaaaataattagcgtttgataaaatcacaaagaagcaatgggtagggactcatcaatgtgtgaagtgactgagcactgatacacataacacagttgacattgtctttaatatttattattgaataaatgacagcatgtgaacaaaagtgtatgcttttcacactagtgaatacttggtcattaaacaatagttaaataaaaaacacaactttataccattggttataatttaggaaaaagaaaacaaaaacatctgacaatagactggattaaaagttaaagattttattttgtggttaaagactacttctacagtagaaagaataaaaacatatacatattaatatagattgcaaatttgctaggtccggatctttgcacttgtgttctctcccaaaataatggattttctgtggattttattttggaataggtatttctcctatgaagtctgataaatgatattcccactctaaagagcaagcagctagaatgccatgtttttgatgcatatttttgcagcacagaggggattaaattctaaatgtctcagctgttaaaggccccttcagacttgcccaaaatgaagaacaaagaaggagaaagctttccctaaagcaattcatcagatctatttgggcacagtgacattttctcagaacttatatggataagttacactgaacagttcaagggtttgcagctgcttggaatatttaagaaaaaaatatctctagttcttatgcatttcatatggtctgaccagtgctcaacactagctaatgttcactgaggctgtaaccatcagtagttatgtcgtaatagcttttgtttctcgagagctcattatgtgcctggtactgtgttctgcattttccactcattgtatcacttaatatttatgcttctgatcttaggggaatgactgtttatattgcatatatgccatttttttgcagtatgaaaaatttgttgagccgagtgtcatacattataaactgacatgtacttactgttgtttaatctaattggtggttgttaaatctaaaggatgttctgactacttcaataaaggcagcagcaatcacttccataaataaatcattagacgtagaacacatgtgtaaacaggtagagtcttctaatttgctaagtgttgatggactcaaaacagttactagaacaagccatagatggaatacatttattgatggaataagtcaaacaacttgaaacacggcattgtggtgtcttaaatggtaattcaaataaaatgaagtgattgatacatttttacttgtttggaaagtggagaatattttagaattgcaaaacattgcacttttatatacatttatcctttcattatcctaatgtagggtagataggacagttgattgcatccaacttcatttatttggcttattatcttttgttttatgattttaactctgtctagaatcatctcctaccacttagagtctatgtattcttctgaccaaatgacttcaagttttctgaccaaattaatggcctttcaaactgttaagccctctgcctggaatgcccttcacatcttctcttggcgaggccgccgcggtcctcaggactctgttggaatatcaccaccccagacaaacattccctgaactgttcctcctatacttacccttcctctggcctcccacagcaccctgtgtatacccacattagcatcatttgacacctggtattatagtgttctatttactggccagctgcaccaagttgtgactctttggaagcatggtgtgtcttttatggttttatttcggttttttcagcacctagccaagtctacacagagtatggactcaatgagcgattgtggcttgaagatgtaaattctttagtatgtattgcatgatatacatgtgagacatgcatgtatatcatgcatattagtactttgttcacttccccacctcccacatccctatgacacacacacattctcattgcattcagcgatgtgtagccttctgtctcatccatggttttcattgtagttgctgaagcttgaggtcacgatctggtggaagtgactactagaagaaggcacatgtgcattgtattctgttgtacttgtcatctggagcacacagtgtacttgaaggtatgccttttctagtggaatttcagagtggtttcatactagcagtatgagaacactttcatgctaaacaagaagggcaaagaatcaaacccgggcaatgtaacagaaactgagctgggggcctgagctgcagaaggaacctctgtccactgcagaataccactcccagtggcacacagaggagagggtgtctggcttctgctctctggttgctcccttcaccctctctgtgctcattacttggttccctttgatagaacatgagaggcagacatgggttgccagggagcaggcttttacaactgctatttcatcctgttttgaaatttctctcaaaatggttgacttatttttctctcacgtatgcatacgtatgtgttgctgcacacaacagtggattcagaaaggctatccacatctttgtccccaaacccccagccatgcaatgcaatatagcaaccaagagaaccagagagccgtgctgagctctgaataaacaaaagcacaaatcccatctgggtctccttcaaagcaagctgctattttgcaacaagctaccaaatgacgattaagaaaaaggttcttacctgtttacttaatgggtgactggcctctttgcttttatttagccatctgttctggtctatgtccctttaaacttgtaagatccatcacttcattaaactgttaccttgacacattgcaatgttgtggacataatgattccacagaggagcaaattaaaacagtttttcatgattagaagcttaaatgaggtaaggctgtggtagttagtggtgagataaggggtgttgaggaggcagagctcaaggggctttcaggcgattggaagattaggctggcgagatggagggctggggcttttccaaattatgggaggtgagcaagaagcaagactgcctttgggtatcgctgactcctgggggctggttccattgcccatacagaggctgtgaccctggccctgggaggatacaggaactgccttcaggtttcttgacttccctaggagagtctgcgaagagcaaaaagaactaattccaccgggtagtggtaagctgaaaatgcaacaacaataaacattttggtctttcacagaaagttatgtggctttccttaagttcgaagaagaatcagggggcccagcccaactatatgaaagaatattttattgtgtctttaccctgcacttcatggcttcagcagtcctccttcttgctctagacttaccttccacctgactccttgacagttgctgaaaactagaaagtcaagggctttatctttttactatcttatgtcagttcctgctctgacaactctggtttcttctgatatgacccataatattgccgtcacatggaccccaaatctgaggaatctctgaattttccgtcagccgcttctgtcctgtcagtagcccaagttctatttctcccacctaaatcaagtttctcacatctttttccaccttgttatttcttcttcttctgccctagttttcatccctcattacctctgtcctaggcaattgggatagcctcctaactagtcactgcctacctatactctctccctgctccaaagcatcttaaacactgatgtttgattataactcataacttccccccaccccgccttttttttcttttttaaaaaaattatactttaagttctgggatacatgtgtagaatgtacaggtttgttacataggtatacatgtgccatggtggtttgctacacccgtcaactagtcacctacataaggtatttgtcctaatgctctccctctcctagccccccattccctgacaggacccggtgtgtgatgttcccctccctgtgtccatgtgttctcattgttcaactcccacttatgagtgagaacatgtggggtttggttttccgttcccatgttagtttgctgagagtgatggtttccagcttcatccatgtccctgcaaaggacatgaactcatccttttttatggctgtgtagtattccataatgtgtatgtgccacattttctttatccagtctgtcattgatgggcatttgggttggttccaagtctttgctattgtgaatggtgctgcaataaacatatgtgtgcatgtgtgtttatggcagaatgatttataatcctttggttatatacccagtaacgggattgctaggtcaaatggtatttctggttctagattcctgaggaatcaccacactgtcttccacaatggttgaactaatttacactcccaccaacagtgtaaaagcgttcctatttctgcatgtcctctccagcatctgttgtttcctgactttttaatgattaccattctaactggtgtgagatggtatctcactgtggttttgatttgcacttctctaatgaatagtgatgatgacctttttttcatatgtttgttggcttcagccaaaacagataaatagacaaatggaacagaacagaggcctcagaaataatgccacacatctacaaccatctgacctttgacaaacctgacaaaaacaaacaatggggaaaggattccctaattaacaaatggtgttgggaaaattggctacccatatgcagaaaactgaaactggaccccttccttataccttatacaaaaattaagatggattaaagacttaaacataagacctaaaaccataaaaaccctagaagaaaacctaggcagtatcattcaggacataggcatgggcaaagacttaatgactaaaacaccaaaagcaatggcaacaaaagccaaaatagacaaatgggatataattaaactaaagagcttctgcacagcaaaagaaactaccatcagagtgaataggcaacctacagaatggtagaaaatttttgcaatctatccgtttgacaaagggctaatatccagaatctatgaagaacttaaacaaatttacaaaaaaaaaataaaaataaaaaaataaacagccccatcaaaaagtaggcaaaggatatgaacagacatttctcagaagaagacatttatgtggccaactgtcccctttaacaaaacaaaatttcttttggctttccatcacctagcaaacttagtatagatgtattagcttgatatctgaggcaattcagaataaagttatcatttgtgtttctagctttttctccttcttcgtgctccagtaagacaaactactgtacgcctatgagtaactgtatgtattcttgtctgcgtgctgtttcctctctctggaaagctctgttcacacatatctgtcaattaaaacacatgcattttatcaagctcaatttcaaagacatctttgctttctctcttctcaatcggatgcagttgttcctgtttttcttccatggcagtatgtttagaggaatgttctgctgcttggcataatttttttttcctcttgttacttttttgaatcttacttttgcaaatcctatagcacaggcagagtttcctactcatacagggtgctagatacagaaacagaagaatgagtgataatgatactgtgtctacaagaatgtgaacatccattcattcatttatttattcattcatttgtttcactcaaatgttctttgaatgcctgtagtatgtaaggtaccatgttaagagcctgggatacagagatcaagatgacacagtacattccagttctctaagaactcacaaatccatgtaggaaaatcacataaataattacacagtgaaaaagtacaacaatagaagtgtctttaaattatgggaatgatgggactttacctctgttagagtggataggttgggggtcaaagcatggtggtgaggaggggattgagcaattagaaaaggtttcctgtcattggaaatgtctgattggggttttgcaaactgaataggagtgtacaaggaatatagtgagataaggaagggtggagatgcaatggaagagttcaagaaagcagctctgcttgctctcagcagcccagcacactaggacaatttggtcaccaaataattattttccatttccaggtaaaatatgctgaatgacagaatccttcgacccctatgaaagaaaaagagaagaataaaggaacctccttctgtgactgcctttggttgaaagtcattcgttcttctttttgtttttttaatgttttgtagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagaggtaagatcccagagggttacctagcagttggagagtatccatggtaacagcttttctttaggagccagagggcttccaactcactgaacttactctgtctgccccggagagcttgcttgggtccctgacaacatcttctgtcttattattcttagacatttactgacaaatgtctaaatctgccacccctcctacattaaatcttctgattcactggcttcatatggagtcaaggaagcaattacttgttttcctggtggtttgtggcacaacgtacatatctctccatttagaagctctgattagcagttaccagctggagaactagctggcttgatttcctgtaggtcaactggttggggagagctctttatagaacttcaaaaatgcatttatactccttaaaactctgtaatccttagacctggagctagaaaaggccaagctgattttaaaatttgcagtggctgcagagataatgggatttaaagagttttcaaatttaaaggggttaaaatcgtgtaaatcctataatcacagaagctttaaatctttgtagccaattggtagtacaggagaggatggaggtatattgacaactagaaagtgcacactatgctagcgcttttgcaagcaagcatttgtctcataaagtaaaataaaaataatgaacctcacaaaatatgtgatgtatatagaagtgcttaataaaattgttttcactattcatttctatggagttggatgaatgtgagtttaatattcagagacacaaagtccaagcctgtttgaaattgttggtaacaaaggtacaagctaccagtgtgtctacattactagggagagtcttggatcagctcccatcgaaaggtcattttgtaaagatactagagggtagagtcatgcatggaatgctactcctgtcctgagagttattcttagcattctgggaggatgctaagcttggtctacccccttttgtagtcaatctcatatctgagtcattgcttctggttaatttgattcttcgaaaattgtttctgtatctgcaggatttacaggcctttattagaattttatagttgaaaaaaagcaccattaataacacataaattcttagaatctttgatgtttatcctctaattggttttaaattaatttttttacagtgtctattgcttgaatttgttgagtgtcctaataaattgattacctatataaaaatgtatctctttgaggagagtttgtctcaccctcatcttttgttacttttatttctggctatcatttaatattctataactctactgtatggtgttaatcaattcacaagtgcctgtcacaggctgaaaatgaaacatgtgactaaaatgtctcacgaagtattctcatatgggaaatcccgtcaaatatcaaagaccctttcatttctttaaatattaatgaatttgatttcggagtgtgaaaggaaaaactgacctatggatgcagttatttaattagttctattaactgggctatctttgaaattattttgatgtagtttttaatacaatgattttacaaaagaatattgaatattattttgctcctgcaaaggttatttcttaggagaaaacatagttactggaaagaatctgggctttggaagcacacaggcatggtttgagagtcagttctaacatttaatgaacttaagcagtatatttgcttttgggtaacttccttaacctcagagccccaatttccttatttgcaaaataaggataacaacatcagcctagcaaaattattttgaggataaaataagtcgaagtatatgaggttcccagctccaaattgctattcaatgaatgaattgcttttgctttctctgtactttccagtatggcataaagtgttcagtatgaataacatcaaattatcacagtccagagtaccagaatttatatgtacattttaaagatcctggacttgggggaataaacacatgtaggggttctcaatctcattagtaatcatggttttacaaattaaaaccacaatgagaaaaatatttaaaaatcacaaagagatactaatatacatgaaacgccagattggcaaaaaattaagaagtctgacaataccaagtgttgacgaggatgtggaacaacagatactattgtatacttgtagtgggagtaaaaattgtaatacccactttggaaaaaacagctccactgttgtattgagcaaagttgaagatttacatgctgtatgcccaaccatttctagtcatggatatctacactagaggtgctcatgaacccgtgcactggaaggcatggacagaacatgtagcagcatttttcctagtagccggaacctagaatatacctaaatattgatgagtaggagaatgaattagagtcgtgccacatacatttggaataccatacagcaatggcgatgaagaaactgcaagtatatgtgaccacatggaagataaagcaaagtacacaatgtgattccgtttatgggtcacaagaagagactaaactaaataatgttgcttagggacatatacaacggtaaactaaaaaaggaaaaaaaaagcaaggaaattattattatgaaagggggtctagcggttacctctgagaggagtgggcagcttgtgatcagaatgggtttctggggatttagcaatatactatctgttgatcctgttggaggttacacagatgttcacagtccatttattaagtataaatttatggtttttggacttgtatgtctattttattaaaaaattcaaaatatattctgatcccaggaaggatgtttatttaccatttaccatggggaaggaatcatacaaaacaattcacctaattcagcagcaggaaataactaaaaagaagcaatgggatattaagctatctaaagcaaactaggaatatttgaaataggcaatttgattttctataaagactaacagacacataagcaacttatttctctagttctggtctatgcatgatagaccccatattgcatcatgaatgcaggtgatagagcagaaaattttgcatgaaagttgaaaacattagaacactcaaagggaatgacagattttctcctaaattcaagtagttctaggctaactcgggagaaaataaaaactttgtgactttttaccacccttctcaatgatttcatcctttgttctgacagtcccacccctaccaccatgtctgtgccatgctcttactcccaaatgattgtgcatttgttctcactgtaatgtcctcaggcgcaatccgttgcagaaatggttacattaaataagagacacagtatgataaagctttcaagagccaaagtaatatagctgaaatgataggtggtgagttcagtgttctaggacaaatagcttaaatagtgaccacaaaaccatgcttcagagattatcacacactaagtccctattcattctattctaattctgagaaggtcaataggcttagctgaactgagtcaggtgatcaccaagctgatctacttatttcaagatcttggcccttaaagttttctcagaagactttccccttaaatgcatatggtttctggaaattactaaacttcttagtatttttttaaatatgcaggcatgccagcagtgatttccagacctagagcatctgcaaacaccatggctgttaatgatgggtttactgcctgatgcttcagcttggccagaagttgctgtaactagtcatagattttatgagctgaaatgattacaagaaagaatgtctctttactactgtctaaagaaaagtggaatgggaggcagcagaattaggtcaaacatctagtggacactgtggagtgtagggttgcttaggagcaaaatctgattctttagttatcttttaaaaatagatgactctggtccctttggattggcacaagtgaaaatatagctggtttgtgaatctatgacagcctgccctgaaggccccacatatagtaaattatacccagtttaagctctgcttcattttatcaattaatctgttttttttaaaaaaaataatctgttcccaggggaaatacaaaaattaaaataaaaggaacacaggagagatgtggttttgcttatatttcaagctgtttatttttttccctgatgtagatccataaaaaagagcatgtgaaaactgtgatgactattataaaggggttaaatagaaagatcaaaatattcctcccactgtaataatgatgatctaaatataacagagttggtgattggctttaactctttacctttacccagtctccccttcactttctcaatgagtgtaagctaaggttcttttctatgggggaggggaagtcttgagaagcagggaagaaaaatgagtgccaactaactgggtgagtgctgaaattctgaaagtcttcgctggccacggagccccaaatttctcatcaacacgtgtttaagctgatagcaaccatgatttcaaaccaaagcttggatcaggagtgatttagattttgcaacagaccctgccctcgcctccctgctgtgtcattaccgtgtctataatgcaatcccccattttaaaaatgacaatgtggagattccacctatagcattatggcagaattactgtattatcaactggctttggatatggtaaaaagtatatgtcacccatgtatttttccagaaaaaaattaaaaacagaaacgtgcttcacaatatcctaaaaccctattttccccttgaaacaaatgctatttattttaaattattaattatagcagacagaggaggtataaaggactaaggtagtccagggcttggttcaaggtaatcttgctttctcctgttgagatcatggcagatttttgggaaaaaggagaaaacgaacttcaagctaggttctatttgtagttgcctatgagggactcagtcattgtgttgtcttttttgttgtgtgacctggtgtgaagacattgctcagagcaagcagcctgcagtttatttgcatttactgctagatgaaaggatccagcttgggtgatcaataggatgccaaggccagatcttattggtaatcagtgagggtgacagatgtcttccttagacctgataggatcttccccttaagatgctggggctacagaggatttctggtatttggggaagagtgccctttccctgggtgcctgaaatgtgccaagtggagaggtgcaagattgccagaacacaggaagcaagtgcagggctgcatactgacttactcgacaatttaatgaggctgaagtatgcctctttaaaaaatgagaacgttttaaaacctcaagtagactaaataggaatatttaggatcagttgctgtgacagacaggccacactagcctaattaaagatgtgcataacatattgatgttgcaatagaatttcccaaattatggttatagtaacaattaaggaagagagctgactttcttggtgataaaagcacacactccacacatttaaataaatgtacacatgtaactaaagctgacatgaataggttttctatatttggtaatagaggctttgggttttacgtaagtatattgagagcaattatgtgcaaatgtatgtcccaaaagtttaaaactgatccatttaattgttaattaaaatccgaacattcccatttatgtaatcataaagcaaaatgaaatttgagtattaaatgttatagaaaaggaaacagctaaattaacatataataaatcaaaactttgtgactttttaccaccctcctcattgatttcatcctttgttctgacagccccacccctaccagcatgtctgtaccatgctcttactcccaaatgaatttgacatgtgtgtattggatttgtcattttaaggataatttatcatttttctcaagtatgaaaggatatattttttgagtggagaagagatgactatgtttctcagtctggttgtgaaatagcaactttcaatcaatgaccatatctccagacaatctatgagtgccagatgagaaggacagatgccactgtgggttagaatatttccaggaagcttttgtgggagaggtgagacatgtgctttggagaaagatttggatgggacagaggaagaagacaaagcagagttgggtaaaaaagcaaaggttcagaatatgtattgtgcattttccttcagcccctatgactcccagtaggccaaggacactatatggaaagctacagtaaagccctaatgtctatgctggtaatcgtcattgcctcacacttggtggatccatttcatacctttctctggattcaatacctttagtcctaatcgtgtggctcttctttttgtttggctggttatctagtcttgtagtgctcttaccttggccctactgccctgcatactatgtagggggtcacttctaataatgcttctctctgtgtacccctgacatggacacaactccccatttccaaggggcccctgaagtactgcccaggcctctgcaatcctctgacttccagagaaggaagtcaggcacatgtacaggtaatacataggtcaacctggctggaacttactctggaatatagaagaagatagaaaatgcattcattgggtaattatgatctgggaatgtgagtgggattatggaaagaccacactcctatttagacataggagtaatacatacatgtaatatatatatacattcatagttatgaatcagtatatacaagtatatggaaaatacatacatgtatgcatgcatgcagcatatacatgcatacatgttcacagatcaagttctagccacttaaatacaaacatacatagaatatatacaacatactatgttatacattaaaatggtatgtaaaatggtgtgtaaatggtgtaaaatggtatatatatacacacacacacacacacacattatatatatatatatatagtcaggtaggtgtatagtgtgccttttgcggttgtctactctccaccttccctttattagagaaggtggcccttccttttgaccacaagggtgagcagaaaagtcaggctagtgattggtcaatcaagtgattggttgaggggtgggctcatggcccaagatgagccattctgaagccttctcaaattttattatgtttttctgggacacactggcaggaaaggcccccttttctctggtggtaaagctgttgggatgtgattctctggatgtcagtagctgtgttcccaagacagaatgagacaaagacactgagagaagcagaaacaagttgcaaggctaatgtgaagacccagacaacacttcaggtcctgagctcaattcttgaaggcagcctcccctcccatcccccatggtttgggtgtataagccaatatatttgtcttctttttacttttgctggtttgaactgtttttgtcccttgcaaccaaaaaagtcctagctgatatattgtagttattttacagccaccaccaccaaatgttcagtaactcatctttaaacaaggtgccatctgaaggaggagaggagtagtctttccaaatctgcactctcaaacctgctggggggccaaacacaagtcacatccatcagtcagtgcaggtgtctgcaaggggtgaacgctgtctatctttctgcttaggtgcatattgcttagtaaactagcttatccttttgtggtagaaaaatgaaggtcaatttcccaaggttataatgccagaaaatggctggacaagactgactactacctgaattgctagtcgtactcaactgataaatcatatagtttcattataattgttagatgaaaatttctctattgctgtgaggcatcagcagtcaaactagattgattttcactttacaaatcacattttttattgatgaaaaatccattattatcataggttttaatgtagtgatcggttcctcaggaagatataccgcagttttatttattacagagccttaggtagaaaagtccccatttgccaactatcttgttaacgcacttgaaaggggcctattagaaattcaactatcaaattacctcatttgtgacaagcaaaggaaaacaaaacagtgtatctatcacaaataccttgatttgagggttgaaaaagatgatagaactcatgtcctgatgtagagagtttttctatagctcttctcaagctgatggcctggcagagtgactagtgcgaaaagctttcatcaaatggcaattggtattaaccaaataccaaatattttgaaaagtgcttattctgttccagacattgtgctaaggatcagcaatgaactgtaatttaaagaagtgttaaaattggggttcaccaaagaagagaacaacatggacccaagttaggagtatcctggaacaataccacctagaaggtgtttgcattgcagcctgtaatgatgatggctgagtaaccatcttacacaagaaattcatttcactgttcttaagaatagtgaacattcaagtaatttcaattaaacacttatatttaatgtctaaaaggtaatttgtcactaagtagatggcatcaaattgtgagttcttatttttcagagtagccttacaaagccttattcacaaaagaaagatagccattacagaatatttcatttcaaaaataactatatgcttttatatcaaatgttatccaccactgccccccacccccccacaagtttgggaaatagtatgtctggttaaccgagtcatctgactaataggcatttgccaagtatttaataaatggattctttatttattcatttattgacatggagtctcgctctgtcacttaggctggagttcagtggcacgatctcggctcactgcaacctccacctcctcggctcaagcgattctcctgcctcagcctcccgagtagctgggattacaggcacctgccaccatgcccaaaaattttgtattttgtaaaaatacaaaaattacctctagaaataccctgctgtggtgtttcataatatgtgtatttgagtatttgctctgttgtcttcttcaaatatgaacatttatgaatcccaaagtatacctggttcaaatgattttagataagggattgcaggcctgtgtcaaacacagactataaaaatgattaagaatgaataaaatacatgggaagcaaagttctagcaaaaataaaatatctctgaaaaataattgaatataatgactagaaataaataaataaaattgtaatacctcagtggttaggttaaatgacagtcactgtgttaagtattttatgtgccattttcttttagctcttacagagtacatactattttactgatttaactaatttttcaaggcccccaaagtattgattctatgctagtgtctttcattgtcctgtgtggcaaaacaagaacctaagactatcctagtcaacaaattcctttaaatggtttcacagagtgtctgccaattcatgaagtcagtaagttcatggaatcccatttgttgaatttactacatgcaacgcactgtgctaggctctgaaattgtaaaaaagaaaacactttttgcctagggataaataaaattttttcataatgttaaaggctaataaagaaggtagaataacatgtgaaagattattttaactctttaaatgtagtcatagaaagaaagtttggagataatacttcaaaatattaactgtgatggtctatatctgggttgtaaattttagaatttttttaaaaaacatgttttccaaattttctacaatgagcacatattgtatttattactagaattttttttttttgagatggagtctcattctatagcccaagctggagtgcagtggtgtgaccttggctgactacgacctctacctcccaggctcaagtgattctcgtgcctcagcctcccaagtagttgggacaacaggtgtgcaccaccatgcccggcttaatttttgtgttttagtaaagacatggtttcaccatgttgcccaaggtggtctcgaactcctgagcctgatccgcccgccttggcctcccagagtgctgggattacaggtgtgagccaccatgcccggttgaagaagtattttttaagcaatgtatatctgtgaaacactctagaactttcactatcatttaaagaataggatttaaaatgtctagataaatatattgtttggaatactttaaaaagtgaatattctcccattccttaaatgtgggtttctcctagtgactcccttaataggactacaatatggaaaggagaataaatagtaactgtggtggaaaggctgacaaacactatctcagctaagtgatcaaggttaacatcaatagtgacaaatggtgttggtagtatatacccttggtatgatgtgatgaaaccgacactttaccactgaggccatcttccccaaatcccataagcctgtttaatcatgagataaatatcagacaaataaatattgggggccgttctacagaacacgtgatgacaactcctctaaactgttcaggttatcaaaaacgaggaaagtctgagaaacccccacagccaagagtgtcctaaggaaacatgacaactaaatgcaatgtggtatcctggatgggctcctgaacagaaaaaaagacattagatcaaaactaagtatgagtaaagtatggacttgagttaataataattaattgtaacaaatgtattatactatacgagatgttgataatggagaaactgagtgtgggctatatggtaactatcttctcaatttttaaataaatctgaaactattccaaaatataaggtttgctttttttattaattattgcactttcatttttttaatttttcacatatatatatttttattatactttaagttctagggtacatgtgcacaacgtgcaggtttgttacatatgtatacatgtgccaaacactgcatgtactcactcataggtgggaattgaacaatgagaacacttggatacaggaaggtttgcttttaaaaaaggtatttaggtttttgacctgtgcatctggaaggttggaattgtcattgactgagatggagaagaccataggagaaggtgaattgaaaaaatttgaaatatactagtctagccccatagggcagggatgtataagatacatgcattgtgaatacatcactgttttaatattctgtatttaatacaataaatattttggcagagaaatagtgagtattctagaaataattcctgtcctctttaagaagtacaagttcttcaaagattccccaggaacagctgtgcaagtcagtgtggctttctaatctctttcatctatacttacacactataacagttttttctattgcaatgcagcccaagttttttgcaaggtaaattatttgtgatattcttaggaagaaaaggtagaaagtaaataactttttggtggcttggtatggtgttgtattttgccaataactatttatttccaatagtgtttaatgatatttattggattgaagaaagttagctatctttcaggtatctttcccagagctcacaggacaatatttccagcatgcccccggaatggtagacatgctgaaaatattgtcctgtgagctctgacaatctagtacttgtcacaaataattatttttacaattattattactattattattatattattgctaccattggtatacatacacacaaatatatatatatatatttggtctttttgtgctctttattttgtttcattgatcaacatttttttggtaaatgctatttttatataattgttgcttgtagtattagacctacttctttttgctcatcttttttcagaaatctttaataaattcacctctgtatgaatttcagcatcattttattaagtagatgggaaatcttgggtgtgtcagaaaactatttgcataataatgctgtgtaagaaatcacccaaactcagtggcttaaacaattgtttattcttgctcatgtttttgtggaccagttgccatccaggctgagatcggctgtgcttagttccaaagctgcaagttgggtcctggtctgtttcatgtgtctctcttcaccaatgaccattgagccacctggggcatattcttctcatggtggaaaaagcacaaaagactaagttcaatcttgaaagcacattgcaagcttctggtggcctcacatctgttaacatcccattgatcaaagggaggcccaaaatgaaggggggagtaaagtgcacttcacccaccatgaggtcaagtcaagttacatgggcaagtccaacatcaatggagtgggaagtatactcctcctatgaaggtgagagtagagagagtgactatttgccaaaaataatttcattcaccattctggtggaatatttatgggaattgcattaaatgttaacttgaaaacagacactattagaacaattgccttttctactaatatcttatctacacaagtaattgttaagtaatttgctaaaaaagactatgaatgtacatttcaagtagacttcctgtggtatctagtaggagcttaaaaaatgtttgctaaactgttattcatggatattttgtatttttcttatcttgagtgccagctcttaaaatgatatgtgtaactattttagcatgcaaaaatactattaattttatatatgttttcctgcatttggttgctatactgaactcttctaattaagttctggaagttttgggtttttttttttttttttgcattgtttaggtatgcaatctcaatgtttttaaataatctttttctcatttcttttcaatattgattgcattgactagagcttatcaaacaatagtaaacaatactgtaagatttttaaagacagtacttctaatgtttactcacttagtgtaaagctgacctgacctagttttctttaccatattaaggaagaattcaaatgtttttaaaattatttttctaaaataatgcctatgtgtgttgagtttttatcagatgacttcctggcatctattgaaatgactggatgatttttctcttggaacttctcaaggttgtattttcttattttgaaccaccactgccaattaatttcttttttttcatagtgtgtatattagtcattgttctctagagaaaaaggaccaacaggatgtgtatgtatatatgcgtgtgtgtgtgtgtgtgtgtgtgtgtgtgtgtgtgtgtgtatgtgtgtatagagagagatattgagaaggagatattttaaagaattgcctcatgagattgtgggagtaagccagtaggctggagactcagaaagatttgcagtttgactccaaaggcgatctgctggcagaattcctctttgctcagggacaccagtctttgttctattaaagctttcaactgattggataaggcctatccagtttatgaaggataatctgatttactcagagtctactgacataaatgttaatctcatctacaaaatatcttcacagagcatcccattttgagaagcagcctcactgtgtcgcccgggcgggagggcagtggtgcaatctcggctcactgcaacctccacctcctgggttgaagcaattctcctgcctcagcttcctaagtagctgggattacaggcacctaccaccatgcctggctaatttttgtatttttagtagaaacagggtttcaccatgttggccaagctggtctcaaactcctgacctcaagtgatctgcactcttcagcctctcaaagtgttgggattacaggcgtgaacccccatgcctggcccagaataatgtttaaccaaatatttgggtactatgatgcagtcaagttgacacataaaataaaccatcacaatgtataattcttttaatgaattgttgaatttgaatatttctcagaaatattctttgggttatacaaaattattatcccatataaaagaagaggcagttgaggctaggataggtaatacaactcacccaaagtcacacatgctcaaattggcaggactgatatttgtccctggctccaaagccccaggttttagtcatataatcaattacacagaaaggacatccaatatgctgatacattattcttcagactggccttacttcctttgctcgggagtcacctgcctataactctcatatgtgatttaatcttgattgtttttgttgaattggggaacttcacgaatgagaagtagaggagttgagatttttactttctggcatgagctaccgttaaactgattatctcgctgcagtccacatctggaccaagtacaaaagtgaagcctgacttcttactctgtggtgctgataggaataacagccacaacaccaccatttttgccatcttgctgatgaattgacctcatatttctctacctacatttttcaaaatagtgctcttttatgagttactcaagccccattttaaaagcagtgtggttgataagtatgtttcatacctgcttgtactgagcttttttaaccttgtgctcttgaaataatatgagcttttggacactatgtattcagtacagactttcagagtgaaaatgttgattttcccaaattaaagaactaggggatatggtaatatatgctctcaattttgaattaggtggaaattgacatcgtttgtcagaaatatactgaggataaaaatgaggtaaagttttaggtgctgagctgtgtgccaaatagcccttgtgtttctttcttgaacatctacttcaaagaagcagatttgcctttgatatccctgggagccacatgaatatgaactgactccaattgccctcatcatctccagaatttattttttatttttttagggcatgagtctgtggtcaatttgcttatttgcttctccaaaccagcatgatcattataattctccttttcatgaaataacccactctcagcctgttgttaatcctacctagaggttgggagtggagtcacctaacatgagggcattcatctcttcagtaagtggtgtgcttgtgtcagaaatttttatgcagacaaaaacacaggaatcatcatggcaacagaataatattcaccacctgagccaccttgacatttctcagctagtaggaagctttcttttttcttttgtgcttttaacatagaagaatgcctcctaagttttgcaggctacatagtcatgcccatgagcctcctcttttcaatgcatcctgcccccataaccatttttctctgtaagtgatgttaactatgcagaaagccaattaggagattctacttagaattccttctcttaactgtttctcaaagcttatgtggtataactgctagaaaaagatgtttgaaaaataataatatattctatattggccattcaatgtctcaccttcatgccttagctcaaactggcaagcttctttatgccatctctacatgtagaaaaagtctaccgattccttaaaatcccatccaaaggccatttcctctgtggtggtttgcctgtctcacctccttagcagtcacggctctctctcatgagtccttttaacactttaataataactaataattataaacacatggatcattctttaggttttacaaagtttgttgacacatcatttcatgtaacaaataatcttgtggctttgattatattctccatttttattctctttctctctctttatttatttatttatttatttattttttgagatggagtcttgctctgtcacccaggctggagtacagtggtgcaatctctgctcactgcaacctccatctcccaggttcaggtgattctcctgcctcagcctcccaagtagctgggattacaggcatgcaccaccatgcccagctaatttttgtattttcattagagacgtgatttcaccatgttggtcaggctggtctcaaactcctgacctcagttgattcacctgcctcccaaagtgttgggattacaagcgtaagccaccatgcccagcctatattccccaacaatggagaatattaaacaaataaacacaggagggttaagtaattttttttttcttgagacagagcctcactctgtcgcccaggctggagtgcagtggcgtgatctcagctcactgcaacctctgcctcctaggttcaagtgattctcctgcctcagcctcctgagtagctaggattacaggtgcacaccatcatgcccggctaatttttgtatttttaatagagatggggtttcaccatgttggtgaggctggtgtcaaatcaaactcctcacctcatgatccgcctacctcagcctcccaaagtgctgggattacaggcgtgagcccgtgccaggccaagtaatttgttaagtgacacacagctgtcctctgtcttctgacatcaaatgtcttcctgtgctagctatatactgttggtctcaaattatcattatcttagccaaccgttctggaggacatctgtgtgctaggcattcttctaagtggtttatatgcagcagcagtaatagccaacatcttcttgccagatatccacttagtcttcaaagcaaccctatgtaatagatactattattattccaccatttagaaatgaataatctaagggacagggaagtcaagtaacttattcaaggtcagataactacaggaggctgctgcaagtgtcggtctttccatatccaaaatctggtgtcttagtcagtgaaaatgctgcaaaacctcaaaattgacagaggccaccctttagacataattgctacaggaatattgatcccatctcctcttgtatttcaaatcttcagagtgcattccacagccttttgcctgtggtatccaagaccatagaggcaagaatgtctgggaaatgtaggtgttagattgccagcctctgctgggtaagatggcagaagagcatagaggaaggtaaaaatgaatactgggtaccagtagacaatatctagcatactcgtgataatgatgtaagactactgccatttctttagaatgcgatcctggtgagatggccaatgaatgtttagtcactcagatatgcagtggtgtccccctaccactagggggagatgaacaaccggcatagtttgatgtcttaagaaagattatttgttcatgagtaatggaaaaaaatactgagaaagaagtggttgctttctatggcttatgaggagaagcttatgctgtctttaatgaaaaattaatcagataaacaaatgtccagaggaatatatccagatgtattcctatttacagtcacttagtggatgtgccagcatccaaatgcttccttaatctttcaactatctaagtaatgattgaatagaacctttgctccacctttcctgcttaaatgctactttattagcattacttcttgtccataaccatcattgcctaagtgctctgcaacttacctatttaaatactggatagattgtcatcagttcctcatctgaccaatcatttgtttcaccaattacttgcagattctcattctcgtaatggtcctaccatggaactgttgcatctccctgttttcctcaccacctccagctaatcagggtagagtttgctctaatgagcttatgtctcaggagggcaggtctttctgtgaaaaactgtcaaaactcttctaatgggaaacaaatattaatgtaaatgtaggcatttatttgccaaaagagtagtagctcaagaattgctagcaataattaccctacttgccagtgtattgtgtcttttttgattattcctctctttctatgtagagacctgcctaaaatatctcatgaatttttctccctcaagtgtgcatttgtgaagtttctcgaaagattgattggaacacaaggatttcagtttgtggcgtcctgttaatcaggtcagatttgttaaagtcattagtgttaaaaatttctttgtactcacaattctccttacccagagttagttctgtggcagtgtattagtgtgggcagggtatcttccatcaacttagtgtttttaatggagcttaccagagttaatgacagtggcagtccccccagggaaaacaagacagttggctcagatgtcttgtgggagctgaacctgctagaatgttcttctgggggtttcatcactaatctgccaacaactggagtctgtatcctattagtttctattcactgaagttgtgagatgccatgtactttctttttccagtcatctcatttttctcatcttctaattcgtgaaagggacacagaaatatttagaaaaattgggattctgcaaattgtgagattgattttcctatgttcatctcatagtgttcagattgagataaggtactaacttcactaagctcttaagttgtccactataagacaaagtcaatactacttccttggaaagaaataaggccatgatgagttaggttttcaccatgtgtaggttattctaagggtttcaggtctaatggcatcccctgaggtagtaggtagataagctggtcatcaggttagagcctgtattttgaatcaattcatgtgtagtccttacgaccattcattctacagattctggtatctgcccacctctcaggcccctctctcattgcgccctgtacccacagtactcatgctttgcccattctgaatcattttgaatcctaaattatacagtatactttatatttaatacatttctgaattttcaagtgccagctcctcccctcatttacctggtaaactccttaccttctaggtcttttctgattgtcttcttcttgttggtgtgctcaggttcctagtgtagcttatacctgattcaaccagaacacctatagcaatttattgccatcacttttgtgcagagctcctcttatataaccataggcccctgaaaggctggaccctctttgcatctcaagtcttcttcttccattccctgcctgccattagtggtgtctccatgcaggaagaagcatatccaaaaatattttaaattatgtaaatttcaataaagtatttatttcaaccctcagagaaaatgagatcagatttgtacagagatgtggttctcctcaattgtggtaagtttaatgggtgagaatgctgagcaagatttgcattgcatacaaatcacaggaattaggaccagtgattggaaagttcaaaggaagatttaagctcagtataagtaataactttctgggcattaagactgttcaaaaatggaatgtgctatcttttcaactagtgaggtctcaatgactggaagtatttgtaccaagactcataaggatgctatcatatatgttctcatattggtttggaagagatgcttggcagtatcttttctaatcttaagattctatttttatttctgtaaatcagttcaaatgttaacttcttataattgccaattatggcttttatattcatcattattcatttgatattcatcatcagttaaaatttttctattaatcagtcaatgaaaaaattatcttttgcctcactcttcagtgaatctggctgtccttggttgtccatatttcctttcacttctttctatatacactataaaattaatgagacttttaaaaatctttcaattttagtcaataaatatttgaatgttgggccagatgcagtgggaggtacaaagaagatataacattgattacagtagctagtgtttatcaagtgattactggcattttacatatatggactcatttgtttctcacaataatgctatatggtaggtactattttcccattttatagatgagaatcctgaggcacagaaagattaattaattttccaagatcatattgctcttagatggaagaacacaagcaatctaacctaaaatctgaaggtgtaaccattaagcattactgcctcttgatgaataaatttaataagataccatctcttgccttcaaagatgattccacctggtagaattacatgtatttattattcactggataaggctgttcttaattttacttgttgtaaaaatttattctttcaaacttgtctgcattgttatcacttgatagtgttctggcactggccaaacaaaaatccatgtttatctaatttacaccacttatgatattctaaacttgctgtgtaactatatatgtctagtttgaactcaaggtgatatgattgtatctccatgattatgttaattatccttccctgagacttctccatttaccttttgcttttgtggaaatcacaacagcatacaataatccaatgacaaatagaccttttgatttggatatagccatcgttcccacgtattaaatgcatactacatgcagaatgtctaggaggaagtagaagatacatacacccaacaaaagataccatgttagaagtacaaataaagcgatgttggacaaatgaagtgaaattagtagtcacagaaatgagattcaccaatatgcctttctgagcatcttcgttggtatttgttttggagtggtcattatgttggtaatctcacagtaggcaggtaataagttacagtgattcttcccaatcttgcctgaacagactcctcctgtaaacacagctgaaaccctagaaagtataatttagaaaagcaatttttaaattttaatatgcatcagattaaactgaaagatgaggtaaaacaccaattgatgggccccagccccagggtttccgattcagtagatgtgaggtcagtttcaagagtttgcatttgcactttgaaagagctggaataatactaagaatatgcataactcctgggtgtgcattagaatcacctgtgattctggtcacaaaaacaatcaccaaacttctaaataaagacccaaagctcttctaatattaaaccctgagataaatatgagctgtatatatactttaaaaagatgaataaaataagtaaaggaatcatttacccaatttttgatgaatacgtgagtggcagcagttgcggtggtaagttaaatcaggaataaatgtttgcaaagtgaaaattgtaagaagcatctcctcttaccatgcagtttataaacaatcacaaatagggcaggcttgctgagctccttcatacctggcgggttattgtcatgaatttgtatgattattgtgtactttacaaatttttgttttacaataatttgtatttattcattcattcattttccaacccatttattccagctcagccgtgaggatggctggagcctatcccagctgcttagggtccaaggtagtaaccagcctgggacaggatgtgatctcatcacagggaacacacacacacacacacacacacacactcacactcagtcagattgggaccatttagacacaccagtgaacctcacgtgcacagctttgagaggggggaagaaactggagttccagagaaaacccacacagacatggggagaacatgcaaactccacacagacgttggccctggcaggaaattgattttttttcttcatgaacataatgaaatgctgttaaataaaatgatgtcgttcaaggacttgctgtaattaattgaggcttttagtatctccttttccaattatgttttccaattaccaaacattgctcatcacataatagatgctcaagtaatgtttgttaaacaaatgaatatctcttacgataaaaaatattgcaccaggtgggttgactgaccagatatttctaaccatgctggaatgacttatttctgacaaaaattattaattttattgatccaaaaggagccatgtaaaattgttttcctcttcttgcttgctattttcaatttttccaatttgggctcagctagcagtgccacagctgaaaaaagtgcatggattttaataaggactcctattgctgagaaggataataagtgagtctggagggcagggtcatactctcaaagcctttctgatgggagccaagattaaaatgcacagcaggctgagagggctgggaagaagctatgatttctcactgtggatttcctcagagtgccattagtgtaccaaggagaacacaggggagattgcatttacatgaggaaagcaagttagagttcagtgatcttgaattttttggcattatttcaattatttgttggaataatttaactttggcccaaaacatgtgtcttagtattgtatagatttgcagggcacagaatatttctggttttcccctaatgattgtcatggaatgcccttaaatttaatgaataagtgaatcccaagacaatggtatagaggtctctaattccaaacagtaatgtatttttgtgaaataaacaaggctcagtatttccattcgattcggtggcattgatggaatctgagcacattgggcacttcacaacacagtcatattcttattcaatcttcattagaaattcatgagataatcattgtgctattaacctcattatataggtgaggaaactaagtcactaaaagtttaaatgactggtccacatgaaaacagctgatgagtgatgagggctgtcaagacatctcaggttttttcttccctggctcaatgctgctctacccagcacctctgtggacaggaactccttttatcccccactcatttgatgagaagtatatgaggccagggaaaggcaagtgacatggccaagggcaaagggcaaggcattgtgagagtctgttcgggaatcacatctgaatctaaggagaaatccacatcgcctgccatcctaaagagatttcttagttgctccccctcctcattgggtctgtggtgtatttgtgaacaacagctgcatttgcaagtagccaggacttcctccagatgacatattgcgctgccagagtggagacaagcggggctgacttcacaggccaaagagggcatctgcatttgccactcagccccaattattcgaatctgctcatggcaggaggaatggtgggtcccttaggcacagaggccagcctctgatctccagactctctcatttctcctagatccgccccctcatgttgcttaagcaaaagcagggctaacccccgccccttggacaaggggcacatcattcctgcattccccaagcactctctggctgctgtatcagcaattggatgcttgcccaggctctgcaggactctagagtctagagcctgctggcccagaggcaagaggggtgccagatgtgcgagctagcaaaccgcggaagctactgtaagattagagtggcacagaaatagtcgggaaattaccctttccattgggcttggaatccagggtaactgaggcagcaaacaaacttctgtgtgtgtgaggtgtcccagtgtaccagtgtcctccattcgggggtgtcttcttcttggaaggaggactttttcttttaacccctaaagtgtcagggatctaaaagctggttggcaatacttgatgcctaaattgtggcctgggggtcacgatctcctgggtgctagttagaaatggggaatcccctggcccagtccagacctatggaatcaagatctgcattttaacaagatcccaaggtttatttgcatatttgagaaggcctgccctaaacaacactcatgagcctggggagaatcttaaaggcttgtgagacaacttgagggttgtgacacttcctaggtacttttgtagcctacactggtcctgtgtgattgggatctacgtctagcactgggtctgtggcgatactaacttccctgtctttcctggcccagactgacatttccaaagggctgcgtgaggtggtacatactcaggcaaggcattaacagtcacacaggcgctccagggctttctcctggcagtgcttgagccacgtggccctccatggagcacctatctctatcttggaccttttagttagaaagccaacagctgccctgcgtgggggaactgcacagtatgctaatgaaggagcagcatactgaaaatgatgttgtggctattaacatttttatgggtggactgctttgcaaagcatagggaaagtattactcttctaggattaatatatttaacaaaaagtctgccaggagaggaggtttttgctgataaatataattctgctgttgatttatttagtaatggagacttgaaattacaggaatcaatgtgtatatggaagccattgtcatttggttaattatgttttgccagcaggatggggaagcactttatgctcgatgcagccaaatgtatttcagccagaatcctgtgttataaatgacgaacacataaatgtagataaagagaaagacccctataattctagattcctggacacttgatcctccagaagcttgacatccctggccccctgcactggggctgtagcatgtagcataagtaggtctgcttcctctatagcaatactccttaacggggcttattttgcacccatgggatatttatagatgtctggagacattttgtttatcatagctgggcagggaagatgggcaacaagagagtagaggccaaggatgatgctgatgctaagtagacctacaaagcaaaagatggcccccacccccacccctaatgaagaattatttggctcaaagtatccatagttctaaggttgagaagccctattctagggcattcctatttgagattctgactcaaagaaatggggtgaagtccatattctctttgttgacaaataaagaaaataaggtgtgggcatcacatctggttatgtagtattatcttccaagatatccacccaggatggagtcaagatgagtgtatagtaggagagtctggaatagctctccaaccactgtcacttatctgaagaggtctaacactgtcaattggtcgccatcctattgtgaagatcatccccaaccttcctttccctacattctgatgaaccagctgtggtttggaaggcataaactttgctacagtcacagctgtgctatttactgagtgatcctgagagtggtaggcagtgtaatggccctcaaagttgctcacatcctaattcctggaagctgtgacctttcatggcgaaggggacttgcagatgtgatttagtcaaggatcttgaaaagggaagattcccctgaattttctgagggggtccttgtaagtagaagatgaagacaggggagtcagattcagagatttaaagatgcactgctgctgatcttgaagatggagtgaagctgaaggaaggagccatgagccaggcatgtgggaagttcctaggaaaaagaaaagacaaataatcagattcttccctagagcattcagatggaacacactcctgctgataccttgattttaacccccaaagactcattttatacttgtgatctccataactgtaagataaaagatgttagtggtaatttattacagcagcaatgggaaaccaatgcattaaggaaggcatttttccttttgaatgtcccactataaaatagggctttatccactataaaataggtgttgctcatttatttgttcctttattcattcaacaatcatttattgagtgcctactatgtgtccaccattctaggcacttgggagagagcagtggaccacagagaccaagcaactcctctaatctagtgacaggagactgataataaacttccaaaaaaatacagaaatctacagtgataaatgttatgaattcaagtgaagcagggtaaggcaaccggagtccacatctatttcttacaaatcattcagagcaggttctgtgataaggtgacatttagcaaaaacctcaaggaagtgggagagaaagtcatacagatattcaaaggaagaatatttttaatagaggaaatggcaagaatacattccctgagctaggagcttgattctgagattcaaagagcaagggaaccagtgttgataatgataataattacctcacaaggctggtatgagaattttgggcaacatacatgaaaccccctggtgaatttcaaaacactatgcaagtatttagtcatcattgcatggtccctcggagtgcattttgggggctgccaagggatgtgtagggtgacctttattttgtgtctatataaaagcgaaagggaaatagctattggcctcaggccatggaaattatgcacagaggcctagaaataggagtattttcccaacatggagctgatgattgatgatgattctatgtgtgtccttcacagtggcaaaccttcaaggggcagggacatcattgctgctgtagtccttaaaccctgtggtccagaagggtgctcccaaggtgccaaagggggcccagagcagtcggcttttctgtcatgggggcatacaaagagagaaatcatcaagaaattcaaagacctcaactcctgcctggccagggcccagagagaagcagttaggatagcctctgatacccagccttgccagcaactaatctgccagatgatgaaattgaaatatttgaaatataatccatacattctttttccaagacaggtggtgaaatggtctagtttttacaaaaggctgagaaaattaaaatactaaaatgttgcacatctttgtgtttgggagtaggacttcccctggaagctggggtggggattagagaaggcttcccctggaagctggggtggggattagagaagacacctctcagaatctagagctggcccattaacaccttaggtttaaggagctttctcagcccattttgtatttctaatcttaaaatgaccaaggcaaggtcacagataatatgtgtatttcatccttctttatgctgaagaatccgcttgtaactgaaaggtattttgtatattaattggattatcaggttagattctttttcctaaatgagtttctttaggccgtttctgcttgcttttaaaaaactttagttttaattttagatttaaatggtacaggtagaggtttattatatggatacattgcgcgatacggagatttgggcttctgatgatcctgttacccaagtagtgaatacagaaccctgtaggtagtttttcaagccttggcccccttcctccctcctccgttttggttgacagagtctgcagtgtctaatgtccccatctttgtgtgtgtgtggacccaatgttcagctcctgcttgtaagtgagaatatgcagtatttagttttccatttctgtagtaattcacttaggataatggcctctagcttcatccgtattgttgcaaagaaccttatttcattgtttaaaatggctgcatggtattccatggtgtgtatgtgacacattttctttgtctaatccactgttgatgggcacctgggtggattccatgtctttgtgagtaatgctgtgatgaacatactagtgcaggtgtctcttggtatatactcagtaataggattgccagctgaatggtatttcacttttagttctttcagaaatctccaaactgcttttctttctttctttctttctttctttctttctttctttctttctttctttctttctttctttctttctttctttccttctttctttctttctttctttccttctttctttcttttaattatactttaagttctgggatacttgtacagaatgtgcaggtttgttacataggtatacatgggccatgatggtttgctgcacccatcaacctgtcacctacattaggtgtttctcctaatagtatccctcccctatccccctgcttcctaacaggccctagtgtgtgatgttcccctccctgtgtccatgtgttctcattgttcaactcccatttatgagtgagaacatgtggtgtttggttttccgttcctgtgttagtttgctgagaatgatggtttccagctttatccatgtccctgcagaggacatgaactcatcctttttaatggctgcatagtattccatggagtatatgtgccacattttctttatccagtctatcattgatgagcgtttgggttggttccaggtctttgctattgtgaatagtgctgcaataaacatacgtgtgtatgtgtctttatagtagaataatgtataatcctttggtaatataaccagtaatgggattgctgggtaaaatggtatttctggttctagattcttgaggaatcaccaaactgtcttccacaatggttgaactaatttacactcccaccaacagtgtaaaagcattcgtatttctccacatcctctccagcatctgttgtttcctgactttttaatgatcgccattctaacggcatgagatggtatctcattgtggttttgatttgcatttctcttaatgaccagtgatcatgagcttttttttcatatgtttgttggctgcataaatgtcttcttttgagaagtgtctgttcatatcctttgcccactttttgatgttttttttttcttgtaaatttgtttaagtttcttgtagattctggatattagccctttgtcagatggatagattgcagaaattttctcccattctgtaggttgcctgttcacagtgactgaactgatttgcattcccaccaacagtgtataagctttcccttttctctgcaacctcactaatatctgttttttttaattttttatagtagccattctgattggtatgagatggtgtctcattgtagttttgatttgcatctctgatgattagcaatgttgagcttttttcatatatttgttggccacttgtatgtcttgttttgagaagtgtctgttcagtttctttgcccactttttaatggggttatttgtggtttttttcttgttgacttaagttaatcttatagattctggatattagccctttgtcagatgcatagatgtaaatattttctctcattttgtaggtcgtctgtttactctgttgatcttttcttttgctgtgcagaagcccgtccgtttaattcagtcccgtttgtctatttttaattttgttgcatttgctttggggatcttcatcataacttatttgcctagtccaatgtctagcagagtatttattaggttttcttctagttgttctctatttttttgataaaataaatgcctacattttgcagaactgaaatattaatgtgtacatgttattgtctgagtaaactttgtttttttagactcatagtaacaaaaggaaaatagacatctttagcaactctttcagtaacagaacatcttttgtataacctgaacttttatgtcagttcaggaatataagaggaaaagaaaggaaggcttggcaagataggtagctccctatcaggagaaacgaaaatgaaaagaccgtcggatcagtgtatactctgagttctgtgggagctgagtctgtatcctagaaagcatggaaaagtagtctagggcagaaataaaccaggcatgctgccaggatgaacaactagaaaaaccctttggaaccatggtctgtcaaatgctgatgtgcaggcagcttcctctgtccccaaggtcagaagaaattcctatatcgctacttctttcttctcctcaacatctgaagcaaaaccctacagagtacaaaggtaaagtgaagacaaaacaagtccttctagcttcaaaatgctttgatattctttgtcttttattttcataagacttgatagcatgttaatgccacagaatagcaggattcccttccattatatgataaacatgctagtgaaaaagaattataaaaaaaagttttaacagaggaattatggcaacctatgagaattgcttcaagtggaatatatattcatgtattcatcaaagagttgtggtatccactagatgtcaggcattgagcaaaggattggacaaggggcaagtagggcaaggccctattctgggctcctggaattcataatataaatggcagcatagacaaatatgcaaatgaacaaatatgcagttgagttacaaattgtcaaaggtgttatgaaagaaacaaacatgatattctgctagagttatgactgacaggtaaagggtgagtacccaggaatggccttgctgagatttaatctgagagctgaatgatgagagggagccaagtacattgttataggtcagaaacagaaacaatttttactctggctcttctgggaagacatgaaagcctgtgtttacaaaaggagattttgacttacctagtcacatgatctaaagaaacgcttttactcttattcttctaaagcgacatttcctggtcccccaccctcctgaccacatttcatattctttttccctgcattatttttttctccccaggtattataaatatatgacatactttttcatttactaatttgcctggtttaatgtctgtctccaccactagaatgtaaactctataaggaacttgtttcatccattttgttcatgatggctgtctctactgcttagaagagtaaccggcacatagtagatactcaatgaatatgattcctgctatactaagctatttctttttgcccctggagagggagatatggaattttgaaaactgccaggtctggaagaatatgctatactttccaaggttgttagatttgaatgagaaaaatatacactaaagtgagttccatgctggtgtatagtaaaggctgagtaaatatcattcttgggtacttccctgtctcttttttcctaagcacactcagtgaggtgggagctgtgaaacgttatgaggtaggagaaggtgatgtctaatgtttctctactgccctgttggcgccccccaaccaagtatctctcagtgcctttgcccagccttcctctgcacacactacagctagctctatcatttcctcatgccccatcaagtcctacctgtcttcgcagaccctcaggttccttggctgtggcttacaagggacatctgattaatctgtaaccaattcatgttgatcccctagctgattgcctctttgtcaccatgaggccagctccttaccatgtgtgggtgcagcaagcaggtacaccatcaccctgcttgtgggatcaggctccttctcccccggacagtgatgaggagacactgtcttcatttgcctctttacctttcccattttaaagctgttgactaacttcaaaaagaatctttttgaattccttttactcatagaaagcagaacaatggaatagtaaggaagaaaagagaaatcaaggctgcagaagagaagacagaggcacagggagagcacagagtagagagtaaggggtaagagaagagaagacaggagaaaagagaatgaataaaagaacaagagagaagagaagcagtgggtaaacagcctgttagatggtggcatagcttttacccactgaaaagatgttcacagcaaggtctatcaaaaccctaccacagtatagcagctctaccttgaaatagtatttctaatgataaaaataataacacaataaagtttagtaaacagtatgctaagagctttgcatatgttttctcctccatgatccttttgattgaaggcaaattttgtcatcctatgctcaaaattcttcagtcacctctcatcttactctgagtaaaaggatggggatctgctccccaccctttcttccaagtaggacccgttcctcagccccagctcagacagtatgcccctcccactctctctcttgctccctccattccacacacactggtctccttgctatttttgatcaaaccaattgtccttcctcagggcctttgcactggctattgttttgcctggaagagtcttctcttagatgtcctcctgactctctcccttacatcctgtgggggacttcttcctttgcttcttaagcaaaagtctcccatggccaccccctataaaatgtcagcccccactaccatctcttcctcctgctagctactcccccactttgctttaattttctccatactacttatcaccaccaggggtataatgttattttatgtcaattgtttgtcttttgcctccagattatgagtacagggattatgtcagctttcttcttgattcatacatcgtcggcacttacgcctcgaaggtggatactgtttttccttccgtagtagaggggaaaaagtaagctcacaccaggtaagtaaattttccaaggtcacagacaggaggtggtgaagccaggtttccaacagagctgtgtccatgtccaaggcccatgctttcaaccactgtgctagaggattccccaacggctttccacactgttaggacacctgtccgaaagggtaggttggcatttcaggagatgcctttctgtgctcagtcaagatcaatgcagatgtaattgtgtaaagcaagacaggactataaggcagatataactgcgtaaagcaaaacatagacttataaggcaaggttggtacaaatgcacatggctaaagcttgacctgtacgatttactttggctgcaatgcacagctacagaggcagtggggtatggtgtgtggtggttaaggacatacgttttgtgagatagatgtggcttccaattcctacggtgccactacttagttttgagaccttggccaagttacataatgctcctgagcacccagttccttctacatgaaatggggctggataaatggaaataatgcctacccttagagttgacttaaaaattaaataagggaatgtatacactgttcttagcatagtccctggctcatgtaaatattcaataaacactaaataaattactattattataattattatgacgtttacttagtatatagacgtagagaaagttttagttgaaattgtatctgttaatacattattattttctgttaagaatgaacatctacatttggaaatagaacaaaaaaagagcttactgcatatcctttcactgtcatgccacagcattgtctaatgagccgtcctaagggtcatctcactctgtcagacaatgtaattttgtttggcttaaaattaccactgattacagtctagcctctgcaaagttgatgttagcatgtagaaaattaataagatgcaaatcactgctgtccaatagagaggcaaatgatttctaacaatagagaataaaacagtagagaataaaatgttaggattttattgccctttagactattaagcagttttggatatatgacttaaaaacgttattccagcagtcttttccccatccatccattcatccacccacccacttacttacctacttacctatctcagtttcttgcattctccttgaatccactttattattttgttggttcctttattaatgattttaatatatctttgatacatccccctatgtatttgtatgagaataagtttatatatatatataccaaaatacaatacaatacttacataatatagatgtactcctagaaagcaattgatggtatctaagctatttaatcttggcaaaccctatcagatacctagtttctgtgctgctactcctgatgatattgactccttataagttttactgtacttttgcttactaaatatcagaaaggtataacatagtgtttaagatcagtggctctggagtcaaacttcctgggttcaagctcttgctctatctatcactaattagctctatgatcttggaaagttgcttaacctaccaacaaaatgaggccatatgaatacctcttatctcagagaatattttgaggagtaaatgcaataatgtatataaaagtgcttagcatggtgcctggtccatggtgtttaataagtattggttattatgatttatgattgatcttcattttggaacttaataaagaaaatgaaactttgcaattctattgtgaatgtttgattttaatacttcctcagcaaactccggtagtaattgcataatacgacaactgtttttcgtagaagcctaccaactagaagttctgaaagcaagtgtttaccatgaaaggtgtttaactcttagagagccctacaaattaaaatagcctacacagaatacaactgaaaaatggcctctactgtttattttctaactttctacactatggtacagagataacttattgtttagtagtgactggtctagtctgttttattgacttgtgcactttctgaccctgtctaatttagtgtcagagatcacctgtgatttttgtatatttccgaatgtgtaagtatctttcccagtaacttgtacattctgatttcctttgcacatgagaattgatgtggaaaaggcagctgagcagaggttggcaacctttctgaagtgctatgccaacttcccatttattcactctaatttaaggttttccatgccaggatgaacctcctatcatccaaaccactggagactgagaacttccaagacagagcaaggctacagaaattgaaattttcattgtatgatagattttccaactttttttctttcctgaaaaccaagaactttgaaaatgctgatgccaattttatgcaacccagacagaacgatcatatatgtagggaaggggttggtgaagattgcagttccaaaacctcctgaagcttttcatacaacatttattcattcatgcatgcatgcctatatatatatatatgcattgtgcattcatttagtaattcattcattaaatcaatgttgagcgtctaacaatgtgccagccactctggttatgtatttacatatacaatacttaacttttttgactaagtgagagaacatacttcatgcacgtagcagagtgcctggctcatagtacatactcagtaatgaaaaccattagttttaatcttctgtttaaaattttacaaaagtaataaatgtacatagtaaagaatctaatagtgcagaagagttgaaataaaaagcagcaattccccatgctgcttctgttttctcccaatcatattctccagagccttaattttaaaaaaatcagttcttctgatatttacatatgtaacattaaataatgcaagtaccagtggtgtgtatcctcccctagactctcatagggaaattctctgcttgttcagcctaggttcaccttggccaggggtagagttccctcttatcacttttctaatgagattcttaaaagtgtccatgactgttgaacaccagacttgttgtctaggggaataaattggcgtggaggagaccactctggaggacagctcatcttctaagtcctttttgcatgcactgctttccagacctgtgtggaaggcaatatccttttcatcccttcagaatttcttctctcttcttgttgcctcttgcttttcttacatgtttctctgtgttctgggctttccaagaaaaaacaccctgaaagcctcttagtctggctttttgaatttttgttttcccccttggtaaggactgggggtggtatggcaagaggaaaatgacccaaaagatttggagggaaatgcgcagaaaacagctagattaatatttcaagatagaaccatcctgatatattttcttattttactattctttgatttatcaacttcagacattatttattgactcctctctataaaaaaggaggatttatctcatgcttctttctatctgctcctctccttcccaaagttggatcattatgttagcattttggttcttctgttgtttctctttctaggtttaaataacaaacttagatctctttgcatcaccttgaggcagtgtctcttgtctgtccagcaagatgagggtatttgctcccctatgcttttctcccctttttcattgtcaaggttgctagtgttctattctatagatgtatttaaagtttctaagttttatatatagatagcttgactataaaagttgaaaaatggtatacaagatttattttataatgtcgcttagaaaaatttgaaaattgactgtgtattagaaattattcactcaaatgcattattcatgtaacatttctgttggttttttttcaacataaaaatttcaagagaaaacctagctcatttcaaaatccagattttaaaaaggttatttttgatttttattttttaaagcaacggggtctccctatgttgcccaggctggtcttgaactcctgggcttgagtgatctttccttctgagcctcctgagtagctaagatgacaggcgcacatcactgtccctagcacaaaatccaaattttcaaacaagttttaaataggtaaactttatcatgcttttatctccctcacaagatttactaagcattgggttcaaaaagaaatatttaagctttaatttttaaaggaataactactgacagttaataatattaagaaaaagaacatgaaaatgtcttttgaatgacacattttaaaaacattagtttgaatccgatttcttcagttcaagtgcaattaatagtctaataaaagaatcatcaataagatgggtaaatgtgtgaatcatgtcttagatttttaaactaagacaagttgaaaataaacacattttctggcttcatagataagccttgtgttatatcaactctgtgacatagattaaaattacaataatggattaaaagtattattttatctcatctaagacatgtaatattagtactgtaatgtcttttagtacttacactaatatatgggctgacagtggtgaaacaaatactaggttcctgaagctttcctaagcattataattctgatatatgatcatattattttcaacaccacatctcaattttctgacacattttttacttttataattctaggatttgcagcatcacattcttctctaactccttgcttatgtgactaagaaaagtgtttaactaagtacaaaagttcagagtgtaacttagtgttaagaagtaagccagattttgtcccagatcttacatactaatcagctttcactgagagattaatttactagaatttcttttgagtgtgcgtgtctccattcatacaaagattcggctacatttttcttttttgtgtattagctttgtcaagtttggcattaggcttatgctggttttataaaatgaataactttctatctttttgttcagcctgggaacaaattatgtagcatagtcattttttgaagatttcaaagaacgtttttcaaagaaatgtgtgggcctaaatatccttttggaaatatttcatttataacattttcaaacattttcataattatctatattgttttaaactccttcctgagtcagttttaaacacttgcacattcccagaaaattctctttttatctaaattttcaatttttttagtataaagactatatggagatctgtgatatactttaaaactactataacttttttttataacttctaacttgttttgtgctttctttttttgtctttgttagagtctccatgtttgcccattttgttcgtttttctgacagcctagctgttgaatttatttgtccactttagaattaaaatattgccaaatttattcttataattaaaattttttcagagtttatgagaagtaggataatcatatatcccagttgcctggcatattctggtatatgccttctatcccaacgtaattattagtagtactctctttcctccccaaaatacatcagttgggtaataaattatgtggccactctaatgataagtgaaacatacattttcctctcaatacaatagcaggctataattacaatgcataattataattacagatattgtctcatcccctgggatgtgaaaattcatgttgaggaggttggggtgggggaaggtcaaaaggcttttgatattataaatgtttgtggccatccgaagggccatagtacctaagtagataacgagtttaactgcagtatcaaatttcatgtgggagggggtataagtaggataaaattgtcttaaccaggctccttagagggacaataatgaaaaaagaaaaggttgagaaaaatgttataatgctgtttgaataccaccattgattagttcattttatttttctccttaatagtcatttggtgttttctaatttgtaagtaaatatagtttctgtttaaacaataagttattgtttcaacactgaaatacccttgttgacatcatcagtggtcaacattgtcaacacattgttctgtgtttttggctgactctgcttttcaataccgtctgtccaacttgactatttcctccttttttttttttattgagaatattattgggctcataggattaaatgaaataagatagtaaggcattcagaactgtgcctgtccctcctgctttccctctgtctcactggttattttcaaactttttggtttccttttttttttttttttttttttacctccggccaatctctaattgctggagtgctaaagagcttgagctctttttcttctctatctgcattttattcctgaatgacctaatctaattacattgctttaactccttctgtataactttatacctccagccctgactcgtaccatgagcctctgacttgtatattccattacctgcttgatatttccatgtggatgtataataattatcagaattaggtacaggctcaaaactgaatttttttcttcacatctgttctacattcctcctcgttcctataaatggtattgccattcactcagtttcttaagtcaaaaacctaagatgcattctagacatttctctgtctgccttcctccacattccatctgccatcatgccagctggttatatcaccaaacctgtccacttctcttgattttccttgttactctaatccaagacaccatctgctgtcacctacattctccactggtctcctgcttccactctcatcttccagccctcaccctcatcatccattctccaaagagatctcttaaatatacaactagaattactccactccccttcttaaattctttattgggctttcactgcagtcagaataaacactgaactctgtatcatggccaataaagaaccatgctcccatctcctctccagccaccctggccttctattcccttaacatgcctaaccagtttctgtcatgggcttgcttgctgtttcctctccctgtacgttcttcgggcccacgcgtttctgtggctggccattcttgtctgagcagtctcagctcagttgccaccccttcagagaggcttccaacctggcaccataactaatgtcagctcctttctaccaatgattattgagttgccctgcccaacttttttttttgtcaaatcattgttcgtttgttttgaactggagtgtttattgcagaaatttggccaaggttccaattgagtgactccagctgaggttagactggggccccttgcccagggctgggcacctgagacaggaaacagtgaagggatctgggcctcagagctgtgagatagaactggggaccaggctgcaggtgaggcctgtatggtcaggttcatgcaaggccttcaccacaccatcctctatcaccaggaagaacctctcaagctctcatcctcaaagagtggcaacagcaaatcatctagtaacaaatcagtctccttcccagaggccccagggctgccacccatgagctggccttggccttctgcactgtggcctgtccccactcaccagtcacaaagacacaaagacagtggcacttaaacatggatctggcccccctttaccttcagaaccccagcctactccccaaacccaagcaggtgggtctttgacagttggggtgaaagccccagggattctaaacagcacacccttctttccctggcatagttctgtcaggtccaccttgttcccaggctccctttcaaacaccactaatgccaggatagcatctcccaccatgacaggtgccatggctgcaaagttactgctgaaatcgtgggtccccaagcatccactctccttctctttctagtagtcacgctgctcctgctgctgctgttgctaccactgctcctgctgctatgattctatcatagcagccccagtgaggaccaacccagttcaatgtttcagggcgcacagttgtgccagctccaggctgggccctgtggctgcgacagtcctgtctctgtggttaggcaccacctatcctattcagccttcttagggttatcttagtatttggtatagctccttcttttctgttgtcctcccagcgctatcatgtcagttccgtgaaaaaagagacctgtttcttcattcacaatgcacatgttctcagtacctggaacagctcctgtcccacagtaggtatttgtgtgtatattttatgtaatagatttttggcttaattctcatggagtcaaatgatgaatgtgaaattcttaaatgctgaaggtttgctgtatttagaagtttttgttgactgatgggttggttggttggctttaaagtgaagtaatccatcaggttttatgtatgtgaacttttatggaatttggtgaagtgtgtgcctgtgtagattagtatataggagagaagtttttatttcttttcagatgattagttatgctttgccagtatttcctcagaacttctaagagtgttggtttggggggatgtattcagtattgacaattccacgtttatctacattcagctgtcaggttggttatttaaccattccgaggcttttcttttctattatggtcacttaaaacaaagtaaagcaaaatgaaactagactgttttggtaagcttttattgaaataagaggggaaaatgtaaggggtaaaaattgctaaattatttgaaattatttttggatgcagaggttgactttattgactgaaacagaatttaagtccttagcatcttatctggatgttaagaattgcctatcttttggttgtttccagaacaatcatgtaggttcctttttgcttagactgaaaatgatttgggatgaagtaaaaaattcactccctcacaatggattaattttttttctcagtggagatgccatgcggtcagaatttcttgaaaatgacccacaagcttattactaagcagctttgggccaatgagcagtcttttaaagaaaacattttatttatttttctaattggagaataatctatgttcattgtaaagaaagaaaatagaaattatgtatattcctaccaaagacaatttccattttagtgtatttcctttcagttctttttctgatatactatcttttctcttctgctttgagatgtgcattgtgacttccctttgtgataaagaggataaatctgctggctcatttccttttatagactgccaccttctctaccaacgaagaaaatgtgcattttggattttgcttgagttgaaacaatttatgctggaacaattataaaaagtagcatctgtaatgtgaatttggcccactctgtatcagaaaaaaataacttccaccatagcccgagaggaaactttaggtatctatcaccgatagagccaatgcttttaatacatatttcatgatcacagctgaggcttttccaaactcagagtgctgtatcattcattcactcctttaaactacaagattatttttggctctttgtgttggcacataggcctttccattgctgatctgcatgaaccatttatcaagtcaagggtttaatctatcaaagtcagagtttcttttttctgcctgtctctgtctcgctttcccagatggtattgtctcatatgtgtacactgttggcttaaaaaaggctatttggaatgcaaaggtttatcaagtttctccattttttttcaaaataatatattatggagcaaagtgatattttataggcaataataattatagtgttgatcaggttctaaaacattacattaactataatgtcccaaacctccttcttggctaatattctggttccgttcttgccagtagctcctattttctctactcactcattctgaaaacttgaatcatctttgattttcctctctcccctttccaaacatttattgaattgtcaaattatttggattgtatctcctggatatttcttgaatccatcctccattgcctttgtgtactggactcatgatgttgcctgttgtcttcaaagaagcaggcaattcattttgaatgcttttgatcggatccaaatataaaggccaaaacaaattaagtaatttatttaataacactgactccttgccgcatgccaacccccgatctagactctggtgatatagcaatgaacagtagggttaaaaaaaaaaaaaaaaaagcctaatagaatttacatgccagtgcaggaacaggggagaaagggacaaaaataacactagtaagtaaattataggatgttggatttgttaatgttgttatgaggaaaagtaaagggatgaaaggctgcagtgagacctagggtggacagggaagggttagagttaaatcaggtggtagggatgataatgaaagttaactaaaacttaaacaggcatcataaacaaagagaatacatcaaaaagcattctaattatgtcagctagtgtcctgaatcccccagtcctgatacctaggatacatagataatgcacagggatcttcggtgcctgagcataacgcaatgagaactattataatagccaccaagctgttctccctctctttgagccattcccttcccaggtcagcactttcagcaaaaccgtattgcggtctaaacataagaattgtgcttaggagaaagtgctaaagttgattcaaagaggcatgtccacaataggtaacccaaggtacgcaagaagaaattccaggggccacagtaagactcaaatcaaaatcaagaataatatttagtgaattcttactgtcaaatgaaaaagtctaaagtctttagcctaatattcatggctctccagaaaatagcttaatgctagttttcttttttcttttctttttctttttttttttttttcatttttgagaccgagtcttactctgttacccaggctggagtgcagtggcataatctcaactcactgcaacctccgcctcctgggttcaagtgattctcataattcagcctcccaagtatctggatttacaggcatacaccaccatgcccagctacttttttgtatttttagtagagacagggttttgccgtgttggccaggctggtctcaaactcctgaccccaggtgatcaacccgccttggcctccaaaagaccatgctggttttccaaccttatttcctagcactcatcttcacatccttccacatgtcttccaatttccttccttgttgtctttatttggatggaagatcttctaccacatttttaggttccaaattctatccttccagtgggactcagatcagatgtttcctcttgtatgaaagcttgacagaaatcatcacctcctctttagaatgttaataacaaactcttttctggcatctggtattatatttactatatgtgtgtgcctcaacatttctgttagactaaagctctttgagggtagccatctggtccggctgttctttgatcctttccccttggcccacacagtgttcagcacagatgagggaatgataacaaagtgctcagtggtattttcaatggcctagtttttcaatggcaattcaaaaatattgttgcactggagtgcctccagatgaaggtcctagaaatggtaaaatgtcatgaaatacctaatcagtcaaagacagggaatgtttagcttggagaagagaaaagtaataataggcaaattttttcagtattcagccccctacctgcctccctgccaacatactacacctttttcattatttttattaactgaccttctggctatattcatcagtgctcaccacttctttttttaaaaaaccattttctcccctcagtgcatagggtatgtctcgaatctctccatctcttttgctggcttttttgcccctatcgaatctttaaatgttagaatctaagctcagtcttagatgccctattctcagttctgattaatcgatgcttgtggcttcaattttaacctacatggtggagattcacaaaagcatacattcaacccaggcaagatgtcagaacttccaactaccaactcaacatctctctgaaaatgcttcagaggacccaacatgtacatatggaactcacgaaacctttccacactttctaattttaatgaatgactttgcagccttccctgtattaagtcaaaattctggaagtcacccttgacagcttcttctcccttactccttataaaaaatccatttccaagcctctagtttttacctcctaatgtatctaaaatctacttagagatagatcatttcctcatataggacaccattgtcccttgcttacctagatttctgcaaaaactaggctacccccatccacatttgcctcctccactctgttcttcactcctctacagttaccatggtgattttttgaaatgcagattttattgccttatttccctgggtaagagtctccgggattcttctgtgccatctctaaactcctctgaatatggcccacaggtctctgcttcatctggacctccctgccactccaacctcatctcataccatgttgctcttatcttcctttggttcatccttcaaacatagaggacaaactgcgtcttctgtctgggatgctcttctcttctgtttccacctatttagatcttttacctcttagatcaatcatcattcccttgaagaagcaccttctgatcttcctgaatagatcaaatccactattagagtctgtactggcatcaggttattaaaatacatattgcaattgtaattttacatttattgctgagtatttctgagagtagggtaggaagaaggagagctgcaagacatgaaacaagagaggacctagggaccagaatatgaagcacttagtaaaccatgttaagacattttggatattatcctgaagacagtggggaaccattttaagaggaaatgacaggatcctattaacatttaaaaaatatagtggttgaattatgtccctccataatttttatgttgaagtatcaatccttttacctcaggatgtgaacttatttggaaattaggttattgcagatgtaagatgtagtaggatgagtaagattagtaagatgaggtcatactgtagcagagtgagcccctaaaccaataagacttgtgtccttatttttaaaaatatcatgcggaaagatagaaattcacacaggaagaatgctatgtgaagactggggttatgtttccacagatcacggaactaccagaagttagcagagaggcctggaatagattcttccctagtaccttcagaggtagcatagttctgccaacacattgatctcaaactatagattccagaactgggagacaatagaatgcagttatttaagccactcagtttctaatactttgttacagcagccctagaaaactgatatagtaaggataattctggctgcagtgtagagaatgttttggaagtgggtaaaactgaatatggtgagacaatttgaggctactaatataagagatgacagcagctgtggaaaagattagagaactaatttgcaagtagaatcaatgaagataggtgaatgattagacttacagagtggagagaagaatggcttgagaaatgatggaggattttaaatcccatttattgagtgatgactcccaaacatacatctttagctaagacttctcttcagtcttccagattcttatatccaaatgccagttaagctacacttggtttttccacagtcgctttgatgaatgtttaaagaaagaaattggtaactaatagttaataagagctaccatatagattacaaaggagaattaatgtattatttatctgaataactgtatgttaaaggaagataaactttcattctacctgggaaagagcttttaatcaaccatagctcccaggaatagaatggaatagaaaacctacccttgtgaggtagacttctgtctctgattacttcatgcagggtctaaatgtccataagtctacaacttcagcctgtttatccttctttttttcattcacatggttctttgtttacagctctcatgttgttctctttacattcaggttatatagaggcctgtgatagtcctcatatgatggtaaggtttctcacagcaaagaccaagctttgttaattttgtcagcatatggtgcctaacactaagctgtatacctaaccagttaataactgctgctttgttgagaatgaaaaagtttaggccccaatttcaaatattttctaccccaactatgttatgcaatatattaatactaaatatgccagtctattttcttgcttagtaataaaaatacaacgtgttgagataaaatatttctggtagctaatcaatattccagttctcaattatccatgctagattatattatgcattaatttgattgcatgctctgcagtatattgtgtatgtgttgtgcaaaggcataattgctcatgttcatacataataagtaggtttgggaatttgtctggaggtatatcttagttattaatagtgattgtcaagtgcacatttcaagtttagaacctcgttggccttctgggagtcagagtctcaatttcaaggaaaatttaaacctttcctttcatgtattcctgttcacttaatcctgtcaaaatagaagattttgtgtctaagaagaaagagctagaggctaattaaaggagtgaaggccagggtttcatggacctctgatttctctccaaatgagtgatgaattaaatgtaaataagtcagaaacataccttaggttttgcttttttttttaattgttataaaaaattaatgtaaaatttagcatcttaaccattcttaagtgtacagttcagtagtatgaagcatatttgcattgttataaaatagatcttcagaagttttttcatcttgcagaactaaaactccatacacattaaacaactccccattcccctgtcccctcatttctctcttggtaactaccattctcctttctgtttttatgaaattgactactttagatgctgcactactgcatggaaccatgcagtactggtttttttggtgactggcttatttcattttatataatgttcttaaggatcattcatgttgtagcatgtgacttgatttccctcctatttcccatataatattccattttacatatataccacattttgtttaaccattcatctgtctataaacatgtgggttgcttccacttcttgactattgtgaatttcttttttaactaagtgtatttgaaaatatacagtttctgtatcagttccattttaaattttctctctatgaagatgaaggaagaatatttttatacacttgaaaacttaaaactctttgtcacttaagccttctgtattagtacattctcatactgctataaagaaatacctgaggcccaggcatggtggcttatgcctgtaatcccagcactttgggatgctgaagcaggtggatcacctgaggtcaggggtttgagaccagcctgtccaacttggtgaaatcccatctctactaaatatacaaaaattagcctggcatggggcacacgactgtaatcccagctactcgggaggctgaagcaggagaatcacttgaacccaggaggtgaaggttgcagtgcgctgagatcacgccactgcactccagcctgggcaacagagtgagactctgtatcaaaaaaaaaaaaaaaagagagaaagaaagatacctgagactgggtaatttataaagaaaagaggtttaattggctctgggttccataggctgtacaggaagcatgacactggcatctgctctgcttctgagaaggccccaggaactttacaataataatggaagacaaaaagggggatccagcacttcacatggccagagcaggaagaagagaggcggaagtgctacacatgtttaaacaaccggatctcttgacaactcactcattatcaccaagacaataccaagggggatggtgttaaactattcaggagaaactgctcccatggtgcaattacctcccaccagaccccatctgcaatatgagggattacagttcgatgtgagatttggtagggacgtagatccaaaccatatcattccacccctggcctcccaaatctcatgtccttttcacattgaaaaatacaaccatcctgtctcaacagtcccccaaagtcttaactcatttcagcattaactcaacagtccgaagtccaaagtctcatctgagacaaggctcatactttctgcctatgagcctgtgaaatcaaaaacaagttacttacttccaagatacaatggggttatagacattgggtaaatactcccattacaaaagggataaattggccaaaacaaagggctacaggccccaggcaagtcctaaacccaacagggcagtcattacattttaaagcttcaaagtaatctcctttgactccatgtctcacatctgggacacactgatgcaaggggtgggcccccaaggccttgggcagctctgtccatgtggctttgcagggttcagcccccatggctgctctcttgggccagtgctgagtgcctgcagcttttccaggtgcagggtgcaagctgtcagtagatctaccattctggggtctggaggacagtggctgtcttctcacagctcctctaggcagtgccccagcagggactctgaacatgggctccaactccacatctctcctccacattgccctggtaaaggttctccatgagggatctgctcctgcaacaggcttcttcctagacatccaggcttttcttttctaccacatggacaggctgcaaattttctaaacttttatgctgtgcttcccttttaaatataagttccagttttaggtaatttctttgctcacacatttgagcataggttgttattaacagctgggccacatatcgtacactttgctgtttagaaatttctcccactagatactgtaaatcatcactctcatgttcaaagttccacagatccctggagcaggggcacaatgcagccaggttctttgctaaggcattgcaaaaatgacatttactccagttcccaataagttcctcatttccatctgagaccttcttggcctggacttcattgttcacatcactatcagcacttttgttgaaaccattcaacaagtctatcggaagttccaaacattccctcatcttcctttcttcttctgagccctccaactgttccaatctctatccattacccagctctaaagttgtttcatattcaggtatctttatagcaatgccccattctgtattcattttatgtattagtcagttcttgtgctactataaagtaatacccgagactgggtaatttataaagaaaataggtttaattgatccacagttctacaggctatgcaggaagcatgatgctggcatctcctctgcttctggggaggcctcaggaaccttacaatcatggcggaaagcaaaaagggggagttggcacttcacatggctgaagcaggaagaagagagagaggagagaggtgctacacacttttaaacaaccagatctccttagaactcactcattttcaagaaaataccaagggggatggcattaaactattcatgataatcttccctcatgattcagtcacctcccaccagccccacctcccacattagggattacaattcaacatgagatttattggaaatacagacccaaagcaccttagcttcttattgtagattgttattctctgataaaaactggtaccaaatatttttagacagaataatattatgaaagtcagtacaaggaacgtataaaactctgaaaacagatattagatttgtttggcagattggtgaataggcaatggaagtgaatgactctttatctcctgaaggaccaaggaggctttgaagagaattactaagacacactcataccttttaaaaagtaactcttggtcaggcgcggtggctcatgcctataatcccagcactttgggaggctgaggtgggtggatcacctgaagtcaggagtttgagactagcctggccaacatggcaaaaaccccatctctactttaaaaaatacaaaagttagcagggtgtggtggcaggtgcctgtaatcccagctactcgagaggctgaggtagaagagtcacttgaacccaggaggtggaggttgcagtgagccgagatggtggcactgcactccagcctgggtgacagagcgagactccacctaaataaaataaaataaataaaataaaaaataattcttcaaaattcaatattttccaaacttattagaatctacaaggaactcaacaagaaaaaaaaacctcattaaaaagcaggcaaaagacatgaaaagacatttctcaaaagaagacatacaagtggccaagaaacatatgaaaaaatgctcaatatcactaattatgagagaaatgtaaactaaaaccacaatgaaatatcatttcataccagtcagaatgactgttaaaaagtcggaaaatgacaaatgttggaagatgtagataaaaagatatgcttatacactattggtgggaatgcaacttagttcaggcactatggaaagcaatttggagacttctcaaagaactaaaaatagcactaccatttgacccagcaatcccactattgggtatacagccaaaagaaaagaaattatatttaaaaaacacctgcattcatatatttatcacagcaccattcacaatagcaaagtcatgaaaacaacctaagtgttcatcaatagtggattggataaagaaaatgtggtacatatataccatggaatactacgcagccatagacaaaaaatgaaaccatgtactttgcagtaacatggatggagctggaggccattatcctaagtgaaatagttcagaaactgaaaatcaaatactgtgtattcttccttataagtgggagctaaacagtgggtacccatggacatatagaaggaaataatagacactggggactccaaaaggtggaaagtggttgggtgtgagggttgaaaaactacctcttgggtacagtgttcactatttgagtgatgggtacacaagaaacccaaactccaacattatgcaatatatccatgtaacaaacctgcacgtttacttcctgaatctaaaataaaataacatttcaaatttaacttcttttccacctttattaaaggtaaagctattacttttgttttaacactatagtgaatagaattttctgtgttgttttaaataattccgtgatctaagtatctgatgcagagatctttaccaatgaacatcaatggtttttccacaaaattaagatcttttctaagatgaatttacaagggctttgagtgtgtatgtaaaaataagtcctagaattcttttacaataatgacaagcatggcctttcaatttttcaacattctgaaaattgataaacaaagtcatttaccctgtctctaattttctgaagattagattcattagtttaactcatggttatagtttttgtgtcaaccgtattgatgtatacatcaataaacacaatctttcactttcactcactcttctgtctcctccatctccttccagttcctacattattcagaatccttggcaattcatatgtgttaggtgtgaagatatggaattgtcagcatcaggaaaagctattaccttgctacttcagactgagtctttctcttttctttgtttactttagatgatttcttttttttaaagactgagttcttgaattcttattctctgacttgcttcataatccatttcagaatttcttgctcctacactttgtttctttatgaatcagtctgtgcatgagatattccatttttaacccagcttaaatttctccaatgtacccttgttttgctttcaagacagttagcaactctgaattcaagcctatgatcttcttttagaaacctgatctgacagactcctgcaaaattctaccttttttcctggctcttaatttagctttgaaaatgaagtacatactatttatctggttatacattttaaagtagattctaagtgcaaaaaatgtgcctagtcaattcaagttgactcctgattttttgaaaaaacattaagaattgaataacaagaataagaataaatataaggctactgactgaaatgtgatctttctcttattttgaacatcttatttcacaaagttctaagtccttttctatttggcttgaccgcttccatatgatcatggatataaaacgattaaacagaaagttcacattcagcaaatatcaaggtgttcttaatatcgtaacttgaaatcaatgaagaagtcacattttctgctttgtaaaaactgcctcacatgtccctggtctggcaaaaaaatacacacacaagtactgaaaacagaagatgatagcaccagctaaatagcaccattgctaggcataagatttgaaagccagcactttgcagggaaaatttgagtaaacaacctctgtggaaatacagttaattaaatctcgattctataaactgtgaaccaaagtttatataaaagagagactaagaagtctttgttgtaagtattaaaaattctgacataaggaagtgaccactctagccatatcagtgtcagaaaatgacagtgtggggctccaaggctgagaatcagtggggctgcaaaatctggacaaagaaaggcagaacaagacatagactacagaaaagagaacattatctgagcaataccaggctaatcccttggtgtgaagaaaataggagttaataccaaaaacatatggctcattattcatgtaattatgcttgcaagctatatagtaaactatatgtgaaattttcataccatagtataaattcagtcattagtttttccttttcatatatacattaagtaaatatgtattgaggaccctcagatgtctcaggcatggacctataatggtgaaggattcagctttgccctcaaggatcttacaggaatggggcagatggcaaggaaagaaacaataccgtgtggtaagcacagggcactaggggaacaggaagtagtgatctatttatctggatccttgtgggcagaggaaataaacataactaagaacaatgaatgataagtttacaggagggtaggggagaagattccaagtagaagcattgtactaaattttgagtggggcaaaagttcagtgaaacttttatttttattataaacccaccaaagtaaaagttctcagcttacatattatagatagctctctgaactggatgaatgtcagctgtgatttcaatcaagcaatgatgatatggccagatggagtgtgccacctcccttcagcattttgtcttaagagggtttctaatatggcttgtcagacagtatgtgtattccgtgtgttgctggaaatttgaagctaccgtctagaaacaaaggtcttggtctcagcagcattcagtgagttggtgccccccagtaccttggataaaaaaatgtatcctataaagggctccatgaagcacaaatgtaaaaacatgctacaaaagcatctcttcttttcattgtgccacaggggctatcactgtgagtctgacttgcaaagtgcacagcaaagcgaacctgtggtctcactactttgctttatactattgcccactccagcacctgcataaggctgaaggatatccaccaagagaatgctcatcactttgccaactgccctctgtgctctagcccagggtgggcattttttttttctgtgaagaccagctggcaaatattctaggtttcatgtaccttacagtctctgtgacagctaatcaactctgccgtcgtagagaaaaccagcacaaaaccatctataggcaatagacaaatgaatgaatgtggctgtgtttcaatcaaactaaatttgcagaaacatgcagtggtcccaggccatagtttgctgatccctgctctcaacaatcctttaaggtgtggtatctggatcctagcatatgctgtttctgtttcatgaaacattcctccttcatctctctgcctagctagattttagtaattcttcagctattagcagaggttattttttgagggcagatgcctcactgatgccccaaatctgatggtatgccacttcctctccagagtactgactgatttctggttgtctggagacttgctctctgcacttcagagtatgagcttcctaagggtagaaatctgcttccctttctgcctgctgaatccctggcacctaacacacaatgcctgggacatagaagtgactaaatacatatttgtttaatgcttaacaaatgaaattacttacatcttccttactttgttaggatcataattctagcaggtgaaattatttatggtcttatagtttatgagccatgtcaccatgttatcacattgtaacaaagcaaaggtttaactatatctcggctccagtggcattcagagggctgtggaaatcaatagttttagcttcatttagctaagtggagaatgccatttgggcagtctgtgtctactaacaacttggtccacacccactgctctgctgtctcgaggtggagaataacacctctctgtccccatcagtgtcttccactctttttagaagtactgccagcacaatgctgtctatgctccaatgcttaacaaaatttttagtgaaatgttgcttacctttttgatatatcttattatcatcctagagcccagagaagtgcattagattaacatggaatcagaatccgatgtaaccagaataacttccctccaccaagactaatgctttgttactgggtctaaaatgttgggctcagttcttgggaagacttacttcccaggaagctcctctgtgtctcttaggctcacacttcaaggaggctgctcattaatttttcaacatgctcaggtatcactgtgaatcctggccagagcaagctggtaccttgactactcttttttcctcttccacttgcaggtagaacaacaactaataacaaatgtatatatgtagctcactatgtgccaggtattcaccatctgtaagtgatttaccagtagtaacttaattgaaccttgtggtgattctattgcattatctttatttcaccaaggaagaagctgaggcacagagatgttagttacattgcctaaagtcacacagctagtaatgatggagctaggaatataactcagacactctggttctgagtaaatgccctaaacccatgctgctggtgctgtgatagctgagtctcagcctcttcctttctcctacccctaaagaatatacagtcttcattctacccacttctctctcagaatctcagaaactaggaaaaaaggaggggtagaaaacacataacagtgcataacttatggtacagactgagacttgaggggaaatattcagagaccactttagatattaggcaatgctagctctataataagtagaaaattccaaattcaagatattctgagccttgaaaatcatgagggaaataaaaatgcccttgaatggctatgctgctttctctattcaaagagctagcttggaacactaaaaggatgttcttattcactaagtgtttttcactgtttgagtctgcagtggagttttagccacaaataaatgtttttcctaaaattgaaatcaatttgtaaaataatgtagaaaatataaagcctcttgctgtttttctcagtgataaagcagcaggaccgcagcaggaaccaaccatgaaaaatgtggccacctcgttgagctttgcactaggaagctacttcattttcacatacaaggattctccctattccgtgttgcaaataaaaattagtaaattagtagtactaagtttaatgaactctactgaactctgtgtgatacaggaactgacaactatgggtctgaagatattacatccctgttgctttgtgaaaattatctttactccagacttgatagaattagcgtaaacagataactcatccatctttcaatttaaagaccttccttttcctcccatctttttccttttcatcttcaatggttaattctcatttgaaaggatcattcccttcatagacatatccccggactaaaacatgctctttctaacctaaagaaatggtttcttcataaactcataggcattaacatatttttgtaaggtcaccaagagtgacttgttcggggtacctgaaagtcaatatggcgataaactgaagaatcagatttttcttcctgatttttctaagattattgtgggtaagatgaaccatcactttttgggccctagaaactgatttatatagagactagaaaatgttttacatagagaaactaatttatatgcagattagaaaatgtttttggagtttattttcccactagtaaagccaatttttttctatgtaatgaatccattcacctacccatctacccatcagtctacccattcacatgtccatccatccatccattcatccatccatccatccacccacccagtccaatctataattctaaccatcttgaccctttttatattgcttctctgcttcatttttatctttgcccttgtcatcttttactatttgacacaagttttttatttcatttattgtctgcctcacactttagaatgtaaattccattaagtcagaaattccagtccattttgttcatggtgtatccccagcacctagaacaatacttgacaataaatgataataaatgtgagaaatgttgcaagaatttttattaaatatttatttagcatttactacttttaaagcactggattgagtgccaaaaaggatctaagatgaagcagatatgggtctcactgtcaaggaattccaggccaagaaagctatcaccaaaatatattattttaatggcatcattatatagggggcaaagttgttttcatgagaaaaatgaagcatatgtggtatttatactgtgcctgagtgaaaggcttccccaaggaagtgacacatgacattgaataaggggaagtatttgaaaaccgagagttgtagtggaagggcatcctagaaaaaagtgacaactggaattaacaagtggaagtggaaaatgcaggatatgttggagacagaaaagcaattggttcagtttagaggaagcctagaggccagaaagataataatggagaagatctatttggaaagagtggttgggtcagattatggaggattttgatgtcacctgttggcagtagcgagtccgagattctctcgtatctgaacctctctgtctcccctatattataacttttgaatgacaatattttatgcttcctgttctggtttccaaagcagcaatgtggccatcccagtttgctagagcctggaaggattcttgtatgaaatgcaaattcagtctttgatctacattttgtaggtcaacaacctcagtttcgtggtggtaattacagggctcacaaggatgttgttcttgagtaatgaatctaatatattagtcacaaacagtaagcatctcacttcccctactcctccttttggttaaggagcacaaattgtccccagttctttgagatttcttccgggttcatctggagcatggatttctacctttgcaaacatttaacttgcagccctagagctgtgtaataacagatagtattttctactcctagccttatctggggagaacacacacaaaaaagtgttttttattttggcatgtgagactatcgagtgtgtccttgttccataagtgtactttggcaccaggaagcagagacagcagctttcaagtgatgggagaaacagactgattaagagctctgcctgggcagacggtactgaaactgggtgtgtagtccttgcctcatcatttcagtttttttaatgtaaatttttatttttgattgaaaaataataatgtatgtatttatggggtacaatgtaatgttttattatacacagacatgcacacacacgcgcacacacacacattgtattgcagtattattcacaatcgccaaaacagtttgggggttttcatgaaaaaaattccaattttgggtctgttagtatattttatcatttcccccattctcaattctttttcctctaaattcctttccctctcagttaatgacaccactgtcctatctttccatatacccagaattaaaacttcagtgtcaatgggaaaaactggtcataacatcatctattttaattaaatttaagtaatttatttacttaaaaaatcaagatgaaaatacctaatttaaattaccactgaaggctagcattcatttccatggcatggccatttatttgttctttgacttcatcttctcctattattttcactcctatccattgaataaattctgaaatgggaatagtatcaaatgggagtgttacttccacactttgctgggtggagcaaacctatctcctcacaaaagggatagaagtcagtttgcagtgacttccctgatcctaccagccagacatgctccttgcctctcttcttgcctcctcctttaatatttaaaatattttttttaattttatttatttatttactttttgtagagatagggtcttgctatgttggccaggctggtctctaagtcctgggctcaagtgatcctcctgcttcaacctcccaaagtgctgggattataggcgtgagccacggtgcctggcttctgcctttttgtgataacagatggtaacaggaatgacaccacacttatttgtaccactgtcatggctctaatgattatggctttgaagtagcatcatttgtttaaagagctcaggttggtggcccagcaaactcgggttcaaattatgcctctagtgctgacttaatgacatggggcatgtcgcttgaccttgctgggcctgttttctcatctgtaagatggagattacaaaaactttcaaggtccttgtgggaagtaaacaagttaatatatgtaaggcacatgcacatagcctgggacctggtaaataggtgccaagggtagttattactgtggttgttattgttagagtttttgttttacttgtgctaaaaatagaagattcccaaggacagaagcttcgtcttctacaccttgaagggtagtgtttttaataagcaaaggtgagtgtgtgaggtgtcaggtatgagcactgagctgtggaggctttcttgatcttttgctttgtattttaatagatttcttcttccagtatcctgcctcctggtaatgagaaaggggataaggtaacttacacataaatttggttcaggtacatcattttttgtccctagatcatagatatctatttgcaaggatgcaatctgtgatagctaaatgtttgctttgttttataaaatcaagctaagagaaataaatgttaggtttcacataaaaaaagtccttttcagaaagagggtgctgtaagtatttccattctctcaaagcattctagagacagaaaaagtgttttctaaccccttcccacccccaccattcttttcttttggtgcctggtgaagagtacattaaaataggaaggaacattccagagtgctcaattgcctctgttcagggtccacagctgaatttctaagttctttctcctgtggtttatgcagcctatactttgactacttctagttagacagaaggaaagctcacacattttgcagtgagccaaggtaaaagagaactcttttgtcaaagtaataataacacttagcacttatatagggctttttatcttcaaaaggccttgcaaacattagctaattaagaagtctgctcaatgtgcagcagctgttgaaaaaataaatgtgatgcttgggtgtattaaaaagaagaacgaaaacatgaggacatcctatatcaagcagctgttgtactccgtctaatttgtttgcttcacctggtggaatacatcagacgctaaaatagtcctgccccatagagtaataatggttagggatgaggcagagcttgtacataatggaatattgcaagggctactggatatttaccggaagaggaaaaaccaaagaaaagctgcatcgcctaatttttattacacttttataatcatgggctcatgcagcactaatgaaacagacatctgacatgtctaatgacatgaacatatcgtagattctttaagaagaacctatttgcaagagcaagcattctcatttattcattcaaatttactaccaaatatgtattgagtacttaccagacactggagacatgcatttataaattacttggggacagttttgaaacagctgtggctctatcatcttacatgttatttacctattgtaccttaattttacattaatattgacacacatccacccagacccatattaaattcaatcaacatttttattcgttgattctttggcagaaatgagctaatacaccattgcaagagctgagctattattttggtgatgaaaacaaaatttagaaataaccaaaaaatgttttttttgtggttttctgcaatgggcatttggatatggtcctcttttctttttcttggtttttataacaacagtcattgagctatacctgctgttctgttttaaatacctgtttcaagaggttgcaaattccaaaaacttgcaaatttcaagaggttccaaattccaaaggaggtggtacatgaagagaaaagggacagagatcatataatgtcaaaatgtaagtgcctgcatcccattagagtataccccatgttatttatcaaagtttacacacatgcaaggcgtattagaataccttacttccattgtacagaaggagatgggggaattatactttggattgagttgattgttaaaatggggttgtaagaaaaattatttcctcattcaaggaggacaaattataaaagagatagcaaggaagtgaataaagaagagaaggtgttctaggtattgggaaaaaattgaaacagaaaatgttcctagacaggagaaaaatgtctgaaggaattagaaataggtttatttttgctaaggaaaagttacaagccaccaaataaagtaaagtagcaaggagaagccaagtcatgcaaagccaaggccatagttacaaagataaaaaagcatctacttgtcatttcccaagttcagaggatggaacagcgtgaagtgactagaagcccaggaccaacggttgattttcaaaggtaaatggttggggaggggttgactcggttagaaaaaaagtcaatttcagtgatcacaggctcatcctggagcattgcttacagtaggaaatatttggaaataaatcaaatgtctattttttgttcgatcatatttttctgagaagaaaggattgattaaataaatcaggatttattcataaaatggaatactatgcagctattaaaacaaggaagctctgtcactactcaaagctcaaatataagttgataaagcaaggtaggggaaagtgtgcatagtgttaaaacttgtgtgaaaaatatagatccaaatgtgtgagtgcattcatgcatatttatatatgaagagactatagactaactctggaaggacatgtatgaaaatactacagtggttacccctagtgaagggaatggagaaattggaagactaggtagatgctagactcttactttttagtgtatatttcctccttctcccctaaacctttttttttttaaaaaaagaaaacattttattatgagataattatagattcacatgcagttgtaagaaataatacaaagagatcccatatatctttcatccagttttctccaatgataacatcttatgtgaggagtttaatgtcacaattagaaagttgacattaatataatccactgaccttattcatatttcaccaattttacatgcctttgtgtatttgcatgtgtgtgcatgtttaatgctatataattttatcacatgtgtaagttagtgtaaccaataccacagtcaagatacagaacagttctatcacaaggatatctcatgctacccctttatggccacagacagctccctccttctctcccctccttactcctggcaaccactaatctgttctccaaagccataattttgccattttaagaacgttgtataaatggaatcatgtagtatgtaaccttttgagataggatttttatattcagcataattcccttgagagttatccaagttgttgggtgtatcaattcttatgaagggcatgttgttggattgttgtttttatccactctgcactccacaaatctgatttttaattagtgtatttagaccatttatatgtgaagtaattattgatatgctagggcttaaatttgccatttaattgtttgttttctgttcgtttccaccatttctcatgtttctgtttgtcttttcttatcttcctccgggttacttgaacattttttggatttcatgtttatatatttacagtgattttgagtctatcattttgaatagttctcttagtggttactctaggtattataatatacatatataaagtagtaatatctatgtgaattatattccttttttaccttttgggctactttgtcttacctacaagttaaatttaaaaataaataaaactagcaaaccaaaacactcctacatgtatacctacttaaaacaaataaaactcacctctgtacagaaagattgtagacaagaaaagaagtgaaaaccaaagcacttcagaagtcatgcaaagaaatcttgaataagaagaaaggattaaaccaaaacttttagggcatgactgagaaattgaaaactgggggctgtccaggacattagaagcctggagcagagaaagccatgttattgagtatgtaagtttgttctcacattgctgtaaagaactacctgagactgggtaatttatgaagaaagaaggtttaattgactaatggttccacaggctctacaggaagcatggttgggagacctcaggaaacttacaactgtggtgggagggcaaaggggaagcaagcacatcttcacagggcagagagagagagagagaaggggaaagtgctacatacttccaaataaccaaatcttgtgagaactgtaccatgagaacagcaagggggaagtttgcctccaatagttaaatcagctcccaccaggtcccccctccaaccctgggaattataattcaaaatgagatttgagtggggacacagagccaaactatatcattgagtatccaggccttgtttttttatgacctactgcttaccacctggtagacctcatttcatttcttaaactctttaggtttcaaatataaaaggaagttaataatggaacctacctcgtagaattgttgtgaagattctcaacatgtatgtaaagttcttagtgtcatgtctgacacatagacaaactcaagtaattgcaatcatataactgaaccttttcttgagtgtctactggggtcgcaggggttgcaggttacaatgatatggtgccattcctcagaatgagaagatagtgccccagacatgtttatagaccctttgatacttccctcgttggatgaaaccctcttttcagtttctttccactaaggatagatttcagcatatcactatgcttgaagtaaaaagagcttactccaggcctcttggctcttgtccctaccttagactgatggccttggtatttggtatgtgaagtagcagtttggatatggagtacaaagagtgaaaaaaaggttggatatggatttttagactcttactttgggaggatgagaaaaagttctcagaattgataacattgtccctagtagtaagaaatatcatttttcctgtctttctaggcatccttgttgatagatctttggatagaattttttgcagagaatggatgatgtttactttttttatatgtaaatgattctaaaagttgcttttttaaggctgagcacggtagctcacgcctggaatcccagcactttgggaggccaaggtgggcagatcacctgaggccaggagtttgagaccagcctgaccaatatgaggaaatgccgtctctaataaatatacaaaaattagctgagcatggtggcatgcgcctgtaatcccagctactcaggaggctgagacaggagaattgcttgaacccaggaggcagaggttgcagtgagtggagatcacaccactgcactccagcctgggcaagaagaacgaaattccttcccccccccaaaaaaaaaaattaaaaatttgctttttttagtgtttttgtacaaaggatcatcgtggtatgatggcgcttcacacatgcagaatggtcatcttaggctattgtaaccatgtagagagcaattccttagggtggtgtttttttgttgttttttatttccttcattcccaacttttatggtgtagagctctggctccatttcaaatcagcggaaaaattatcatcagacctaagaatgttttcttttgagatggcgtctcactctgtcgcccaggctggagtgcagtggcgcgatcttggctcactgcaacctctgccgcccgagcggcaagtgattctcctgcctcagcctcccaagtagctgggactacaggtgcctgccaccacggccggctaattttttgtatttttgtaaagatggggcttcactgtgttagccaggatggtctccatctcctgacctcgtgatccacctgcctcggcctcccaaagtgctgggattacaggcgtgagccaccgggctcggccaagaatgttttatatttcctagtttctcttccttttgtgggtcctaatcttttgtttaacaattgatttctacttcattttgactatatattttcttttcaagcctttttctccctgcatcttgccaatatccctaaccccattcactctcggcaaactcgcctaaatctcccaccatgaattttagtcccaggttagacttttaacctcatctcccattgaacaaactgcaaaaaatattaatacaaagggcagtttagagtcaacaaaaattgagaacatttgcagctgatggtaccatctgtgcctgtcaaactctggccaagtagttttccatggtggagaaagagagaatctcatgacggcttttggtttggggttattgagaactgagcctgcactggaggaagactagaagagctgggaggcagctctttctctttgtggtgtgtggctcatctcccagaaaaacaggcctctcccagaaagtggtcaaatttggcatctgagacctgagagtggcctcctgtgggtcctttctctcctagcccatctgcgaaaatcaatctgtgccaggtgctccacatggcagaggggagtggtggagtcatgaaaaagaattaagcaaacaaacaaacaagcctcacagagcacacaagaaatttctgaagagaagtttcccaggcttttgatgaggcgaaacaggaggaccatagagcagcagaggaagaggaagggggaggatatggaggttacctgatggcctaattggttccgacaatgcactcctttgttgcagagaatctgaatcatggaagaagcaaataaataaagaaaaacatatggcagctaagtcatatcaatctacattaagaaaaataaatgagaggatattagggagaagatcctgagaggagaaaggcagatggggactcttagaaagtattcttaaaatgggcaggaaatgtgaaaagggactttaaaaagaggattgtgggatgagcaatgaataagtaaaagggtacttaacctcatcactcatcagggtagtgcaaattaaaaccacaatgagataaaaatactaccagaataactaaacaaaaaatgatggatcaaaccaagtgttggccaggatatgcaggaattgaactgtatgacagtgccggtgtgagtgtaattagtgcaacccctgtggtaaactatttattgctattgttagaattgaacatatgcatatcctacatcatggcaatgctatttctaggtgtatacccaggcacaatgagaacatatgaccactgagcatcatgtacataaatgtttatagcagctttattcacaatagccatatttgaaaataataaaaatgtccaccaacagtagaatagataaatatattgtatatgtcatggaacactatgtagcctgaaatgaatgaaatgagaaagaatgaaatgtggatgcgtctcacaaagataataacagaaaaaaatcagatgacctggatgacaaagaagcatagtgtttggagtgttacatgtatttagcacattatggagaaaatagagtgataacttgagttctagtgagctccaaagggatggaatgatatgtaaaaatcaccagaaatttgtttaagccatactgaacctttctataatgagacctaaatagaataaggtactgggtaatgaatgtttcccaaattatggcatgaatgtttaaggactatttcattttaagagatgcagtgtccagaaattgtcaccatggtagtagtttttaaaatgtgttcctcagagctgattggctctaggagtgtgtaactcaggagtgtcatctaccatctgtttatctatctagttaactatctattgtagagaaggttgtggtggagtaaaccaaacaggcagcttgggattcatttgttggggatctgcacaagatattgttagaaaatagtttgggctgctaaaaaaaaaaaaaaaaaagaaaaaaaaaaagaccacttctttagagaactgttagtgtgatgataagagattatagggcaccaggaaaatctagcaaatacagccatctaaccaaaaggcagtattaccatccttgctttgccaggggcaagtgttgatatagacaacatttggaatttggagtctggagtgaggactcctcggaatatgacacttaaagaagcccctgataaaatctagctaataggtagcaataataatattagtaaacatttattgaatatttactattatttagtgatgtctgctatttttatacatcatttaatcttcacaagagcacagaccttgtagtcatgaagtagctgctctcaggctcaccctcccaccaagaagctgaataaattactgtttgtaggaatcagagtacaccaaaatgggctagcatttgaaagatcaagaattctcaaagaaggaaatgcattgaggtgaatgggacctctgtgggttgtttcctgtgatgcatatgcaatacttagaagaggcatagtagcctagatcttacaggaattgcagtgggactggtagatgaaaattcatgttcagggataataagacagccacaatatgagggaccaagattctggagagaaggaaccacagagatctgagccagaattctgcacgtgactttccctgaggaatttgcagatttctacaccacactagcagtgagatactgagaagccaagaagaatgcagtagtttaaaaggccaaaaatctaagcagaaatgtaagcaatcccagagaactgaagagacagaaattgtagttcagagcctcccaagcaagaaggatctttataaacatggcagattctcaattgagaatctgaagagctagattctaatagtatgggcaaactgaacatagaccattctctagtggatcaagataacctgtgtatgttctgtcttccagaaaaaagtggaatcctctatgtaggatttcagggtctaaataattattttacttaccatgtatgataggcaatagaacattaccaggcatgtcaggaaatataaccaaataaatgaatttcttagtgaaaacaaataaactgtaggttattgatatattgggattatcagacagatttcaatacaactatgattaatatgtgtaagaaaatagatatcagattgattatttcacaactggaatctgtagacaagaatacaggggaaattctagaagtgaaaaacttaagaatctaagagatatgtttaatagcagattatgcatagtagaagagttgattagtaaagctgaaaatgtttataaaaataacggatcaaagcatcaagattaaaaaggtgaaagataaagaaaagagcatagcagacacccagtgaaaaatggtgcttctcaaagtatggtcctgagaccacttctggtgctggtccctgacaacatagagtgttcataaatgtttatagcaattgattttgccacaacattttaatagcatattttatgacaaaattagactctaagggattataaataaaaaggaaaaatattaatcacgactagtttcagaaacattggtataacataagtatgttggagtcccagaaatggggaagagaaagaataaggcagaagtaacatttgaatctctattggctaagaatctttcaaaactgataaagcctcaacacacaacttcaaaaggcttcatggaccctaagcagcataactacaaataaaaacttacctaggtacgttagaacgaaactgctgaaaacctaagaagaagaaaagaaaatcttaaagtctgtcagaaaacaaaacaaaaaaaaccaatcttcaaaggaactgtagttcctgaagctgctgccttttcaatggaaatggtctagaatccagaagtcgatgaagtggcatcttcaaagtactgaaaggaagtaaccaccaacttaattctatatcaagtgaaaatatctttcaaaataaaaataaaatatttgtggataaacaaaagcaggtaatttgtaaacagcaaacccacattaaaatattatttatctatttatttattttttttaaagttgtagagacagagtcttgctctgtcacccagtctagagtgcagtggtatgaccaaagctcactgcagccttgaattcctggactcaggcgatccttctacttcagactcctaagtagctaggattactgttgcatgccactatgcctggctaattaattttttttttttttttgtagaggcagggtctctctatattgcccaggctggtcttgacaggctcaaacaatcctctgacctcagcctcccaaagtgctgagatttaccggcattagtcactgcaattggcccccacactaaaatattgaaagaagctgctcaggcaaaagaacatgatcccagatggaagtacagaaatgaaagaagcaatgaagagtaagagaaaggtttaatataaaggagcatatagataaatgttgtgcaaaacaagtaataatgtctagtaagattaaaatactatgcattaatagccaaaaatgcaggagcagggtaaactattaaaatgttgtaaggctcttgcaatgtttcagaacttatgaaggcatacattatattatattctagtaagccaagaattaataatgcaattttaggatgattactaaaaagaataacaaaagaatttagatgtaacaaactaagagataataaatgggaaattttcttaagtacttgataaattttttaaaagccaggagaaaaatataggaccaaagaacaaatgaaatagagaacaactgtgaatgtgttagatttaaattcaaatatgtctgtatttacattaaatataaatggcctaaacattctcattaaatgacatattgcttaactatgtaaaaaataattttaggctacataaagagacatactcttaaatatcaggcacagaaaggttaaaaataaaataatggaaaaagatatactgtgcaaacaccaatgataaagaagctaatacagctgtactgatattaggcattatagattttaaggaaggaaatcatgttaaaaataaaagatgccatgacatagtgacaaaatgggcaatttgacaggaatatttaatgatccgaaaagatatgcatttagtagcacaaaatatttaaagcaaaaactaacgaaactaagaagagaagtagataatctgacaatcatagttggtggttttaatacccttttccttctttaactatcagcattagccaacaaaactatgagtgaagatttagtagatttgaataacacaattaacaaacttgatctaaatgacatatagaactctacatctaaaagctacagaatgcatttttttcaagtaaacataacacctttaaccaaattaatcacatactggtcaataatgcaagtctttaaaaaattcaatgagttgaaatcacacagaatatttcctctgatcagagtggaaataagccataaattaataacaaaaagataatgagaacatacacttaatgctgtgacccagtaattccattcctagatacctcacattcatgggtacatttggcatgaaaggaagtatacaatcatgttcatgcaaatcaaaaataaccctgtgctcattaacagtggaatgaaaaaattatatgtcaaaatgatacatcatatattcatataatgaaatagtgaatgagctagtggtatgcacagcatgcatgaatcttgcagatacaatggtaagcaaacaaagccagatgcagagaatgcataccataatatttcatttatataagccaaaacaggtaaaattaagcgatagtgatacaagttggaatagtgttctgttttccttgtggacttgttatacttcattaacacatgtttaaaaaaaacccaaaaatatcgcaagataaaaaatgcagaagcattttctgggtaaagaaagatgggcaaacattacaaacagaaggaaatttggggggttcaaattctgtatcagtcatgagacttctttcctccaaaaaacttacttttgaacttttaaactctattaacattcttatctattatttattatggaactagatataaccacttatagtaattgtctcaaatctgatttctttccatctatattacatgtagggtagtacgatgtagtggttaaggacacaactctagagagagactgaggttaaatcccagttcaaacatttgggcaagtcacttaaactctctgcatctcagtttcttcactgtaatgtagaggtaatagcaatatctatgtcagagtgctgttttgagaattaaaagaatcaatataattagttacaacagtatctggcacaaaagtaagcactccgtaaatatgtgtgattgctactataattaccttggaggatcggatcattccttatatttgttttaaatccctcgaatacctagaactatacaagcaatcaggaagacgggctttctggacagcgagaagggaagatattttggaaactgactctgttttctctctgtgggtgaggatgagcttacattgatgacaagtttggcttatgaactaggaccttaagtagagctgcataaattagtgtaagtgttattaataagatgggaagaatttgctttctcagttctggcaggaatttatgaccctgagagtcactttatgaccctgagtttgccataatcagcttagtgttctgataggaaaccaaatggtaaatgccaagacgctggggcattggtctcttgtctgcatagtcaccttactttcactaggatctttattcatgttctttatttaagttgggaacttctagcaaggttatgtgtgtgtcgtctacagatatgtaagcaacctggactctgaaagcctatatattaaaaaaaaaaagtttatggattgaattgaattgaatcatactgacttgaactggagtgaatcttgagagatggctaagaaccaggaaggcttagtggcttaacttgtaaggctatgagtttgattcactagatatgtaaattttcacaagacacttaacttttcaggcccttagcttactcctttgtaatttgtggctaataatcataggaaccccacagggttgttgtaagaactaaatgaaaaatgtgcctggtacatgtattaagcattcagtaaattatagcaattgctattattgcggttgctatttttatttctcagccaagaggctcaagccagggtgaatgaattgtgaagctgcaagcttttcaaatgtgctccttccttattttaaaatcctttttgtttttattctcctgacaaccctgagagcttggacagggtaggggctattatctacaggtggcatttgagataataacatagagagataaagtgatttgcctaatgatctcataactgtgggtgttagagttaaacctagaccccaacattccctagagccagccttgagatttttattaattcctgctctatctacctgcttatctcctgataaccagcaagagattattcttcacctctgtgtagaagatttctgaaagaggagtattatccaaattaccagcaaaagaaaatcttatcttttcagatatgatagatggctgacatagatcagtagaggtttttaagagttctaaaaagttaaacatggaagttttattttagggcctggcatcctcacttacccatactgggactcattttacccttaacctctctccagcatggtatttcatcttactgcattcttcttgctttatagtgggctttttccagttctctgcctaacttaatgaagaagattatctcaaagttcccaagattgttacttctcatttcaagctaccaggagagactcagcaataaatttttatattggggattcagtttccttgagaaatctttaagtcaataaccaaaccctttaaatttccttaacaatggtgactgtagggctgtgggaggtgttcttttaccttccctctcggcactaaatgtaagctccctgaggacagggactttgtctatcttcctgcaaaattcctcaggggacagtacagtgcctggcacatagtaagtgctccttacatatttgccaaatgaagggatgatgtcccaactccaaaatttgttatattttaattaatttcatatctttgttatcttttgctatatggatagatttttagcttagattctgtttagatgctttttggtttgattctggtttgggcagcttgagaaggctgtagaattttttcgtgttctagttagattttaaatttcctagctcctcagtagagttttctgcctctcccttggcccaagtatttaagtccccaaatttacttgcttttgaagactggattttgaatgtaaataaatgaaaaataattattttgtcttaataataataattaaattatagcactaagtaatttaggaaattttagatataggtagggtattctgttgactgaggtcataggatattcttaaaattggttttttgatctgagatacagcattctattcttgccaggtcatataaaatagaatttgctactattacttgtatttgatttcccctgataggctattcagctaggccagccttctatgactgaaaaaaaatctttaacaaacaaagctgacaaaacaaagtagtaaactagcctgctttgggtttcaaggtgagtctccggtggactctggagcagaaatcctaagtttcttctgactccttggcctgtctgatgccataagagggtgcagggggagatttgctctgcttctcttctgtgtcaaggcagactgagaagcttttaatccactatatttcaaacagttgcaagtaaaaaaaaaaatgtcatgggaatacccagatgtgggcagataataaccctactttttactcccacttattaatccataagaaggaagggggtgagaaatagtctttggacggtcagctatccatgtacagtagttggatgctgagcccttttcaaatgtactcagaataaaagtgaaaccctactacttgttttgcccattagatagcattatctccatggaacgccaattcatatctctttgtgctgtgtgtggttctcacatatgggattttaataacctccatgctgtgctatgaatttataagcagagctgatagaggaaaagcaccacaggactttattttttcattattactcttttgaaaaacagggtctgcctcatttctgtaaggttctcacagtactggcaatgttgcagccagaggtatagttgttactatggaaaggactaagctctttatttatttgctatctatttttttccagactccctttcccactgctgtcctgcctttagccacctccgtaatatccactggcattgtacttgaagcttcagtgaactgattgcaaggaaataggctccatttgttctctagctctgtggtttatcttacattctgaatgttttttctgcccatccttttaaatgtggtcacatttctcctctgtataattctgcaggtccaagtatcttatttagtgcagtggctaagacaacaggctctgtagtcaactagtcatggatgtgcatgctgacattgctctctgatccttgagaaattatttgagttttgtaaattcatctatatgatggtaatgataaaccttcctcctaaggttggtgtggttgttagttggtatggtgtggttgttagttggtatatttccttttttttttttttttgagacagagtccccctcagtaacctaggctggggtgcaatgatcttggctcactgcaacctgcattctgtaaaagggactaaaggggaggatttaccctaagcttgattgagtgttcaggaaaatacttctttgagaagctgagctctgggctaggtcctgcatgatgaaaaggtatctgcaaaatgggaggatgagcagaagacaaagaatttcaggaaaaagacagaatagtctcagtcctgaggctgagacaagaacatggcatggttgagaaatgtaaagaaattaagtgtggaggctgaccatgactgagatggccagagtccagggcacctggagccacatgaagagttttgaagtttattcaacatggaacagaagccttgttgatttgggggttaacacaagtagtgaagcagtttcctccaggtttcttctaccaaggaatgccagagagcagtgtcttgctttgtgtgattagtgttttgattcattacttttatgggttgatatgtcttgtgagaatatgagatgtggattccagagcttaaaatctgcacgtttagtttgaatgctaattaccacaaatatgtttttaattgataactgtgtttcgacatacttcattacgtttgacctttaagatcatttttaactcatcctctttaaaaaagttctctttgaagaaaatataacacacatcaatggcattttaattgtttacctttggaatatttttgtgttggacacaatttatccatcaaataaaaagtgaaaaaagtcatattttgagaaaataacacaaaatagggccaagtgccaaacatcctaatatatttgttttctgcatgatttattattacgccttttttggtaccatttactaagaatatgtatgacttaatttttcataatagccagcaatttaaggcagcaaagtatttgctttcttccactgatctagtaccgcctatcattgtatcatactgacctttaatccagctcttacacacaaagtcagttatctgtatacttatcgttttaatgggttttgatagatttccccatgctcatttagttatataaatgatttattatttatgtttgttttatgatagtttttatgggttttgttttgttttggtgaagccattttgtagtctaacaaatatttcttaattgggtatgcatgaattttggctaagttgctccatataaataaatgttttgattacttctaccattgtctacagctgttatcatctttaacctccaagttttcttaattttcaaaaggaatttattgaatttaatctgagccagtaagacgggctttgatgttaagtaatagagattagttgcccctctctgatgtctacgttactgaaaaattattaactaccaaactcctgtgacacagtatccttcaaattccaaaacttagctacagtttaccttactaaaatctctgctactggtaatcagccttttagccagtgcagcatatattcagcttttgccagaagatggtttgctcccaagggcttttggctccaaagactaagtgttacttggtggctttggcaggattcagaggagcctggctgctgggaactgacatgctcagagcttgccagccccaaaccattgtgtacctcacagctctcagtgccaggagtttgtgtgccaagaaaacagaaacctgtctagaaaataaactgttttctcttgcacatgtcctctaggaagacaagaagaggttgaacctgtaaattgttttgtggttagaaatgttttaggtttttacatgggaaatataatgctataacttcatatgtaaaacaaaatggcacattatttatgctcctcaaatcattttacctccaattattaaaatgcttatatatatatatgtatttttttttttgagatggagtctcgcactgtcgcccaggctagagtgcagtggcacgatcttggctcactgcacgctccacctcccaggatcacgccattctcctgcctcagcctcccgagtagctgggactacgggcgcccaccaccacgcaaggctaatgtttttgtatttttagtagagatggagtttcaccgtgttagccaggatggtctcgatctcatgacctcgtgatccgcccatcttggcctcccaaagtgctaggattacaggcttgagccacctcgcctggcccaaaatgcttattaatcttttaagtgatcaatatagttgttattatgatgacagtcatttcagctcttgcactgaggcagttcctgtgtgtgaaaagcttctaatgtgagtgtgtgctgtggatgtatggagatcaccccagttgggtggttgtacatgaatgaatgtgggttatgtgggcaggtaatgctggagaagtcagtggaaggtgaattaaccagctaacaaaacatttggataattgaatgttctttagaaacaaatcgtaagccattaggaaagaccttccttccttccttccttccttccttccttccttccttccttccttcctcccacttccctttcaccttccccttccccttcccttcccttccttttcttttcctatagcacataacattggaattgactctactcactttcatccaactatccctacctcttcttcctacttaccctagatttttatttctatttctctaccagttcatattttcctccatctagttttcatcagagaaaattttctgcttcatcaaacacaaaactgagatataaatgtgggagcatatgaaattagagcttgacctacatttagtacaattagtattattctaaggaagtagacagttgtggaaaaatgaaacttggaacacagaaaaggttaaattcatggcgcttatgtagcttattttcattaggcctgttacctaattacttattagaatttctttctatcttttagaccttagtttctcaaccttagcactattgacattttgagtaggataatgcttcgttgtgggtagggggctgtgctgttctttgcaggatctttagcagcttcttggcttccattcactagatgacggtagtatcccccaattgtaacaattgaaaaatgtctccagacattgccaaatgttccctaggggacaaaattgctccctggtgagagctgcttttttttagatccaggtgcttagacaaatgatgatataaatcagtacattaagtagagaaatttttttaaaaatcagtttctaaagactagatttctcaacaacttatcacattatttccaacaacattcaaattcaaaagctgatgcccaatgctagcaaagtatgaatagatagaaagtaaacatcttcctttgcattagataagatgcccagcaatggaaatccctggatttaaagaccttgttaagatgtattatgtcagatgaaaagtgctattttaataactcattgttattcttagcatggatcttttattttagaaaaatggataattagcattttggcttatcactttcccttaatgaatacaaataatttgatagacagacaaccaagagagacttcattaaataatgggattaatcagcctgggactggagtaaattagaggttagacttccagcctgagagatggaattcagggtttggtggcaatgtcatccaattcatgaaggatatttttcttgattgacctaatgttgcagtaaaaaaccagagcaagggtcaactggccaaaaataaaagtcaaaactcagcttgggaagttataggctacactgcatttaacttgcaactggataattgcaagaacacattcaaagcgtcactgcaaagcccttgttgtttagccctagctgcttcaatttctagataatggtccattattaatgtggaagtattagaaagttttccagggaaaaatatcaacctggaaccattcccctttgcatgcattatacacttcactgccatctggttatccataatatccccaaacccctaccaattttccaaaaagaactacaaataacgctttgtatttttagaacagtcttcctaacacccagagaggaaatctattgtgaagttaattttctttttcaaatgttttaaagtaaactattctttatttctaagaaacaaaacccaatgctatgtttaagcagtgatttggaactgtcttactgtcactcagagaagacaggttagtggaatctttaaggccgtggctgtcttttgaagcttatagtgtagtctttagaaagtcttcagaaaagatcatgattcttatggaaggttatttctgtggggcagtgggagaacttagatctgagaaatcattctcatcatgagttagaggaatgattttattcacaattcatactcttcattcattatccaacctacatagaagccttagttctgtgtatccttaagctgcatttgacattttacctcctgatatttttctaagtagcatttttctaccaacagactcaggtgaaaaagaaatgaaggtatcaagtatatgatgtgtacacatttagctttattactagcatcttctaagaaaaatagcaaagagctaaaacgaaaacagaatgattctataagtcctgaagggaatccttctgtgatacaatacaagcaatagaaaggccttatttctccctataaaatgtgtgtaattgtgcttttccttatttaatcacatgatttgtctttaataaacctctactggctcccaagaagtgtggatcctggtaacaagagagtctttagtgcgctgaaggagtgatggttgtgaggatacaagagtggagaaatgagaagagataaactactatactttactaagaattggagagaaacaaagagtctagggtatgtggtttggaagaaataaagattcaagaggggagggtcttcttccatatccatagagcatcttaaacaaagtttatattgtccactgatgctctgtggggtggctttccttttgtggagtatgagtagcagtgttgaattttacctcaagttactatgggatagatagggaggctgctcttggataagtaataaatgcgttgcagaagttaagaaacagattccagaagtagagaaatctatgcagaagcatatagctagaaagtagcagagtggtaattgaacacaaatctgatgacagagccaatgcttccttttattctagcatgctgctagaaactggttcttttataatagtcttaaaataccttaagtctttgagatgagatgaaagtgaaatatgatgaaatgttgaagattgtaattgaaattatacaattacatatctctttcatattaaactttcaaagtcctggtactaatagcttgtattttaaattatgtcttcattgtttaatccatattgaaaatttggcttatgcaaaattatatgcctttgacaccaaaaagatatagaaaagatatggccactatatgataaatttcttatcctctctaataagaaataaatatttagtcccaggttttgaggtgttatctatactttttcaagcctaaaactttacacttgaaaattagtgataaatagttattataggtaataggtatgtattgacaagcacttgcttgtttagatatgatactaaatggttatttatttatttttatggtcaggtttctcaataatatatccattcataattcattggcttattaaataggctctatatttcagatatatggctacagataggagccctggtgtgaggcagaggggggctgtgataatgacctttgtttcagcagtgactcaaggacaagattccaaggctcagaattttgcttttattttctctgtatgagtgtttttgtctgtcagtaaacctgttttgtgaaatgaaacaaaaaaaggtttgtttacattttggattgcctttgcattagcattttatggcaattggtctggtttgacttaaagtcctcttttttcatctttaaagtgtgaggttgctacaatattaagtgcttaagatatgccactactgctctatcaaaattatccatgcaggtcataaattcgagttccaaaaaatgtaaaggaggtcatccttttgggcctccttcatgaggccccagcataccagacctaaccagaatggagtcttctcatgctaagtgccatgtaatcaaactgaacttagaaactagccagtttcgaaaacaggagtttcacagcaccaaatccaaaggtgccctgtcaacctgagctcttatacactgttggtagaaatgcaaattagtatagtcattatggaaagagtatggagatttcttcaaaaactatacatagaactgccatatgatccagcaatcctactactgggtagttctcaaaaagaaagcaaatcagtatatcaaaagtatacctgcatcctatgtttattgcaccacaatgcacaatagcaatgacatggattcaatctaagtgtcatcagtggctgaatggataaagaaaacgttacacacacacacagacacacacgcacacacacacacgcacacacagaggaatattattcagccttaaaaaagaatcagatcctgccatttgcagcatcatgaatggaactgggggtgattctgttaagtgaaataagccaggcatagaatgacaaatagcacatgttcctacccatatgtgggtgctaaaaagtttatgtcatggaagtagagaatagaatgatagttaccagagttttggaagggtgtggggctggggatgaagagaggctggttaatgggtacaaatacaccattagaaggaataagttctaatgtttgatagcagagtagggtgaatatagttaaaaataaggtattgtattttgcaaaatagctagaagcgaggacatgaaatgttcccaacacatagaaatgaaaaatactcaaggtgatggataccttaaatactaacttggtcattccacattctatgcatgcaacaaaatgtcacatggatgccataactatgcacaaatattatgtattaacaaaaatacttaaaaaagaaaaaaagtcccctctgctttaaccctataaggaaagtaactttgaaatgaccaattgggccaggcatggtgactcatgcctgtagttccagcattttggaagaccaaggtgggaggattgcatgagtccaggagttcgagaccagcctgggcaacatggcaaaaccttgtctctacaaaaaatataaaaattatccaggcatggtggcatgcgcctgtagtcccagctacttgggaggctgaggtggaaggatcacttgagcccaggaggtagaggctgcagtgagtcgagatggggccactgcactcctacttgggcaacagagggagacgctgtctcaaggaaaataaataaataaatgaccaatccacttcttattccttgtttcttctttctacagccctttttttcccctataaaagcctacctctgtctgcttagctcattggagcacctttctatttagtagatgggatgttgctcagtttatgaattgctaataaaagccaattaggtctttgaaactaaatttgttgaaatttgctttgttgatgccactattgctctttatcaaaatgatcccatagatagtctatagtcttttcttagtgttttctcccaaatctgttgggaagatactaagaaagttccgtaagtctgaaatctggtcctaaaactgtgtccagtaggtaccattgtattcaatatagcattttggtttaatcttgatcttctaaagtctgagtatgttctttagtttgtctagtttctgcagtcttgtgtactaaaagggtagtaattttcagttagctaattactatgctttacacagttatagggacgaagcattttagaatggcacttcattaaagcagtaaaaatactgtgggctcagtaatctcatttactgggtcaatagcccataatatctagaagaagatttaaagtagtttaaaaataattattcaaacgagaaagggatttcaaactataattaccatagcagtaaaggaatgaatgactccaaagcaaatataaatattatatttaaatcttaatatctgattgctgtaactcaaagggtttagctcttccaatactaaagatcacaagatcttagacctgaaataaacttcagcaagcagccagtcttggtgtagaaattaaattttttcctgaaaaaccacttgtagttaaatatccagactgacaggctttttgcagctcattcttctataagatgctttttttttttttttttctgagatggagtttcacacttgttgcccaggctggagtgcaatggcgatctcagcccactgcaacctccgcctccttggttcaagttgttctcctgcctcagcctcccgagtaactgggattacaggcacgcaccaccaggcccagctaattgttgcatttttttttagcagagatggggtttcaccattttggccaggctgatctcaaattcctaacctcaggtgatctgcccacctcagcctcccaaagtgctgggattacaggcgtgagccaccatgcccggccaaggtgttcatttttcttagagcatttgcatatctcttactcagttttttcccatgtatttgcattttcgttgctattgcatgttagatttcttctactgtggtctgttttttgtattgttttgttttgttttgtttttgctgatgtactgttggcgattttctgtatccatgttgtggctggttaccatttttaattctcctattagttctaatagtttttctctggttgctgtgtttgcaaggagaactactgtgtcatctgtaaataatgattttttttcttctctatttcagtattaatacttcccttcaccctgcctctgggtttctgtgattacatggagtagagcttccagaacagtgtaaaataaatattagtggacattcttattttggttccagtcctagtaagaatatgtctagttaagagcttctagattatgttccaaaccattattccacgagatgttaattgatttcctacaaaaaaaaagagagtcttctaaataatttccttgaactctgaattaaccaaaatgagacaaatctctttagtgaatgggcttttataacctttactatttaatatgcattgacaatctcctagagatggagaaagtatgtgacttttcccaatatatttgtcatagaacactgtttttgaagaacatttactaacatcttataaaacgatacatcagtggtatctttctggtattgttctggtagggtactgttaattgtgatgtttggggtttttggtttcaaaatgatgttctttaccgtgttaagaaaatatcctacttttagcttacttagagtgttatataaatcaaatcttttactatatgctttattctatctggcttttgctgaatataatgttttttatatttactgatgttgtttatttgttttcaatgctggatagtagcccttacacaagtatcataaaaatttgtgtggtttgcaatttgagggagtttaaacaatgctgctctaaatgtttgtgtacatgaaaattggtacacaaaaagaatacatttttataggacatatagcaggaagtagaatttctgggtcatagagcatatatacattcaggtatacagtagaatgctacagttttcaaaagtgttaatgaaaagtttacactcccgtttgttgcctgagacttccagttgcagtgcattttttttaaacactttaacttttaattaacaaaataactcttaatttcaggtaacctggtatatatgcagtaacatctcgtttttaaaattggcattttctggattatgaatgataaggaccttttcttgtgtgtatttgccattggatttcctctttaatcaataattgcatcttatgccaattttttattgttttggctgattttattatctatatataggaatttgttatgtattttgtatattaacccttcctatgattgtgttctccctctccatagcctgcctttcacttttaatgtcttttgagggatagtataattcattttatcagtcttttcttctactgtgagtgcttttctattttgtttaataaaaatgtttcctacctgatggtatgaaaattttctcctgcactttcatcttaaagcattactctattgtatttctgatacaggttttcaattcacctagaactgaaatttgtgtataagtaagggtctagattcacctttttccatgaggttattcagtgtttttaaaaatgtctcatttcctctgcccagtactctgtttggcactttcatcacaaacacttggggtctttattatgttgcatgggtcaatgtgtctgcccttgtgtccacaccatcttgttcctcttcatcaagggcattagctttcttggccctttgcatctctataaaaatgttaggatcagtttgtagagttccatggaagaaatcttgtggtatttggggattttgattgagattatcttgaacctatagattcatttgaggataatttacctctttacaccattgaattttctattccatgtatatgttatgtctctccaaatatgtagatcctttttaatatttctcaataaaatggtgttattttctccacagaggtcttgcacatcatttattagacttattcctaggtatttaatattttgaggcagtaatgaatggcatcttttcttaaatttttagctatattgaaatacaacatatttggattctgatttgtatctagcaatcctaactctaataaaaactataacaaattatatatgaatttttaataccatgatataatctgtagataattatatttttgtttcttcttcaatcttcaaactttttttattttttcatgacctcagtataatattaaatagcagcggggatagtggaaattattgttttattcctcattttgaagggatagcttccaaaaatttaacattaagtattaagtacaatgtctgctatagaatttttgtttagtaaaaacattttatcagactaaggaagtcccttgttgttttccttaaataacagttttaaattattagtcaacattgaatttcctcaaatccttttgctgcatctgttgagacaatcaaatgattttacttttgagatgatcatttgattttactgttaatattgcaaattacattaatttatttttctccccaactttttttgttgtgaagaattgcaaagagttgtaagtttctgaacaccatttttacttgaaatataacagccaacagacaaactatgaatatttagattttggcatttggaagacattttctcaaaaatgaatgaagtgggcctgcctcttcaggaaaataacaatgattttttagaatataagtgagattggggaccaaaagtttgaaaacttctgtcctcttagaaagtgtaatgttacgctgggcatggtggctcactcctgaaatcccagcactttgggaggctgaggcaggcagatcacctgaggttaggagtttgagaccagcctggccaacatggtgaaacctcatctctagcacaaatacaaaaattagctgggcatggtggtgggcacctacaattccagctactcagctactcgggaggctgaggcaggagaactgcttgaacctgggaggcagaggctgcagtgagctgagatcgcaccactgcactccagcctgggtaacaagagtgaaactctgtctcaaaaaagaaaaaaaaaaagaatggaagatacttaaaacacttctaattttatacctcctctcaagttgtatgctattttataattttcattataaaatttcctctttgtttttgtatgatgaagctttactataatgtttacatgtggatttattttacttgagagtaattgagccttttgaatcactgaattctcataaattctgaaaaattttcactgacttgcctttatccattttatctcttctctccctctgagatttcaaataaatgtatactagtccttctcattgtattctgagtctcttatcttatttttttaaatctcatgtttcattctgagtacttgcttctatcttctctttcattaattctttctttagctttatctaatttgctgttaaattcatttcttgagttctttatttcatgtattatatttatcaattatcgaatttctaagtaactattttacatatctgctccatcactttttatagttttcatttccctgcaaaatttttcactagactccaatctcattgaacatcgtaaacattgttttagtctatatcctgtaattccgtatgtggagattttatgtgagtatttttgttggttttctttaatggtggtttgtttctttttatatctgaagtttttaattgtgtatggggcattgtgcttaaaactttatttgtaacagtgatttgagacctaggatgatattatcttcctccagaggagatttttctttggttgttctaggtgtctaaagtcaatagaagttcaggaacacacaataaaattttcaaaactgaggttatcagacacaacaaattgacataaaataggttgacagattttataagactggtttattttcagttcagacttaatcttacaataactctaggaatcctagttcaaagtgaatgtttgtttacccttgggctctggattctgatttctattcttctaggcccaacatgcttccagaaacagagctcacctattccttccagaattactaatgcccctggggcaaaagcagattttagtgttagtgagctctagtcttctctaggctggtaatttcctaccatcttgttaagtcttcgatggtttagagatgaatttatatttttttttgcagctaagttattttccatagaagggcagtctgatatttgaaagttaacattgttgaagtcaaagttctcatgatggtactttttaacaataatgaagttgaatatcttctgtactttgggttttcattttgaaactagaaggcgtacttatagtacagctttcctggagcctatcccatttgcaatcacagacctttaactcaaagtttatgcaagccacattcttctccttattcctaaaataagcctagtcttagaatgtacaatgtaaatatatctctccttgcctccaaggaatgtacataaccccactaagacagtcatgcttccctatcttttccatttactaattttgccaccatttccttccactttcagtgtggaatccagttgctagtgcccatgactatttctcaacttccaactttcagctttcagtacactacgcaccatgatctcctgactagctgctttcttcattcttgcctctgtgttccagaatattatttaggcagaatacataccttacagtagcttcatcacatatctatagtttgtaaattctagctgaaacatcatttgcaatcatttttattctcaactctcttactcaaaatattctttttcaaaagttcatcctattttaaagtctgttaactgtaactcgaagtaccctatctctcatcaattaacacttgcttccttttagaaatataagagaacctagagtgaatctagttgaagtcctttcttataaagtaacctgtttcttctctcattcttgattcattgttcctgtttccaagaaagatgtatttctgcctttccaaagggtaccaatctaactatactcttaaattattgagtcttatcttccatgtattctcactccatcagtggtccttctcttgtatcgtcaatcattccatctttaccaacctcctcctctcaaactataagcccttaaagtatccttcagcccagaaagcaaaacaaaatgaaaaaaaaaatctgtattgagtgaatggcaatgactgttccatttaccactagctttatatgctggcaggaatcccacatgaaaattaagaaaatttattaggtagtatgattttccttacctccaaagaaaattctagccagagaattgataaaacctctaatgctatataattaaaaataactctgtaggaaatagaagttctcatgcttggcactacatgcagacctccagtatactctccatttgctcttcaaaatgtctgacttctagggctgacttcatgtgtaagtgcttcttgtcaatctgttagtatttgaaggataactagaaggatttcctaccccagcatcttccctaaggattcaaatttattgttttgttttcatccctttgatcaaacattatggtctcctctcttattgtttttaattcttctaggagaatgtttctcaaacctaggcatctattggaatcacatgtgggacttaaacaaaattatgtgcaggtgccatcctcagaaattgtctgtcttatttggtcaggggtggactcccgccattgccatttttaaaagttctcctggtcattgtaatgtatagccagttgaaaactatattcctagttgagtgacatgcaagtacactaataccatatagcaagaatcagttttcttaccttctttttgtgacattcctgtgtggcattttagcagcacgtcctgagatcatcctcctgaaaggagaaaaaaataatcaagaggtaagttggccataaaattatccaagttttactgtgacctaatagtaataataggatatgaattattaccataattcacatccatatgagaaaactctttcttggtttgagaaaacgtgttttttgcctcccagtctggagaaaacatgttgcgttcctctggcacatgtacatgtttatgcagatccattccctagaggaacttccaaataaacggagcatattatatatggcaaccgagaaacatagctttatgttgcctgttgtagaattatttcatgacattaacatttttatgcacccccatattaagttttatgcttagatttaatgtcaccaggtaggaaccaaggtaaatgccacatcccaaatccacatagagtcagagctaaaccatcagttatcaaatctgtctttttatgtgctgtgagatttatacacattgctttagaaagctgcattcactggaagatgctggtttgtggaggggcaaggaagtacatttacaggttagcttggctgaactgtgttgatttctctgcagaacagtcttcacaattctttgctcacagttaaaggtctgctgaaagtgactcagtgtagatgaaaacagcttgcttaatcattcctgaaacacgggaaaaattaaaatacatttttttatcaagcaataaaaacaatgccagattgttaatgcctcttttgtacctttcacttaaaagacctcaaaaagaacatcaaggagaataaaggcaaaatctattccccaatgccgtcattatacatgttgaagcctctaaaactagaactctaaagacattcaggaagagcaggggaataaatgacagcaaactgaagagtgcgtctctggagctttgttcaacctgctttgttcaaattcattcaaattggataatgaaaagcaaagatcttttttgtttcaacattaaagtagtaaattagtgagtggtgagttgctaattgttctgtaaagtatttaaggtgccaggagtgtcccatctccaatttttaaaatggcatccttatggttgaaatgaaaggaaccattagagtagtgtaaaacaatgtttttaataatttatgctggttcaattgaaatgattttcatttagaaatactcattgaagttcttgtttttacttgagataagcaagttttattttagacttcaagatatcaaatagaaattcattttccggatggggctaaagtagaaagatagattagagctatccaatgttgtgtttcaaatctggctgtttctacttgctttgaaggtatagaattagcaggtttggttaaattttacttgaattttgggtgaccttttctaatcctgactgtttcataatttagtgtcttgaccttcgttttccatagagccaccttagtgataaatgcagagatttaataactagaaccagttgacaggtgacctttcgtacatggctgttcctttttgctgtggaaaccactgttttgcaagttttattatttcacaaattttaattatttattctattgtctataagcttattcagagagaaaaaagtaaaggttaaatattacattattcttactgattaaaatgtaaagtgcttggcacttgtcccaatatatcactcagaaaggatagggcaatttgtcaggttcatacccaaagaagagaaagggatggttttcccagggtggttggtaaggatgaaactggcctaggagagtgagcaatcacatcagctaagtgaaggtaacagatgtgtgtgtgtgtgtgtgtatttgtgtgtgtgtgtgtgtggtgtgaattttgaatggaggaacagaagggttcttttactgtatgtgtaccaatttaaagagaaaagtgaccctgagtcaacgagaggtgaaacttgccagtcagggtgaataacctgtcagttttggccatttctctctctccctctctctctcactcactttctctcttacccaggaaagaattggttaagcatatcatggtaaattgatttctggaatctatgtcaataaaatatattgtttacaaacaaggaaataaggctgagtaattataaaaatgctagagacttttagaaagagttaagaatatctacactttccccccaccctacagtatcagagaacataggaccttcacagggaatcaattcctctgtacttacattcttcagtatttttcagaacaattcatttgtatgcctctcaaatactcatgcttataataaaataaaaataaaaacaggcatggtataaaaagacccatcgtgtgaacatagtaccccagtcagccattgtcctggatcctcatagaagagaagagccattcatgagttagagacctcttgacagtcttcaatgaacattgattcccaaggacttgcaaatggccactgtgaatttctaaagtgaatttctgaaggaggcttttgggcagtggggaggtattattccctttagtcctggagaccagtttagaaaataatatcatctgccatggtcttttttgcccgacatggacagtaattatttattgcttgagaatctttcactgctgttgtgaaagaaacagtttgaaaagcaaattgagtaagcagatgtgaaggaccatttaaaagctaataaaattggtcatgattagtttatcttagactgaaatttcagccatatttcaagctgaaaatatcaacaaaaacattttcaataattttttatgtcatgctagcactattgccaaaaaggaatagtggtgaagttattgattacaagcatgtttaaagcattaatctatgatttaattaaaataatttaaatataatagtgagcaagatttgaggtatctgcatatatgtatattaagaatagtgaaaatcagtaataattatttctttgatattccacatttcctaatgctgctgtgagtgcatttcctgaaagttaacatatgctcttctttttaacctgaaaaatatctagtatcctttggacatcatgtttatctcaacttcctcaactcagtaatggaaaatgaattaaggtaacttgaaaaatctgccatgaaaattatgtggaataatgtaataaagtactgagaaatatgactgacctgtaataggcattcaatcatgtgtatatcaaaaattctactacactatacttataggtctctctggtgctgtttcttcccttcctctctctctcaccttctacctgtgccccagccaataatcaagtcattttttcctgtaaggtggcaaaatgtcgagattcattttagcagagaaatgacttgttttacaaagccattccttaggcttctaaaacagcatacgaattgactctagttgatcatgaaactctcccacacagcttagcgctgtgtgctgagattaagttcacactgattagaattttaaaattattttactcttcacagtgccttgcacagaataggtactaaataaaaattatgtggttattcaatagatgtcaccaaattcttaactcctcccaagctgattgttttgaaaccagatgtgctggtatagagttagtatacttttgcagaggaaaaaaatagccaaaacaaatacagtgctgttaccataaaagaaaatcaatattttagaccttaaataaaaggaagtgtttgacatttgtggctttctttaacaaggacatagggacccagacagggttggctgaatatttgtggtgctctcagtttatagacacagctgaagcccagtgaaaatattttgaatgtacaagatgttttcaaagatgctttgagtgcacaagagacaagatgaagaagacaagtttgtttttaatgaaaaaaaaaaagcaaaaaatagagacaattcaactataaagggagaattcaaaatttagatgtggcttgataaagtggaactagataaatcttaacaaagttcttggaaaatccaggacctcagtctagaaagaaagagtaactgcctactgaagcagaactgagtgagtgaagacatatggaataaattttcaagcaaagcccccaaatcaaataatatgaatgagttgaagaaatagcagtacactttaacagagaaagttgagatcaaaagacgtagtaataaagctaataagaaaaactgagataactagataagagcagattttgggtcaaattgtccatttgtgcctaggtatttctttctttttgtcatggcatactgtagtttgaaggtgccttcagatgtataaatgagtcccttgggctttgcaagcaagctttttgtgctacctgaagctcctgattatgattaggaatgttccatttgtctggcccccacactcttgtcatactttaaagatggttcctgcaagtaagtggtaaaatagagcaattatcatgttcatccatgtctcctggtaccttattcaggaaggcagatggctaggcaaaactattacccagaagtatagaccaagaagtacaaacgtctcttaagatgacggccatggtgacagtagggccaagtgaatagtcaaacaaaaaaacaaagtggcaattttatagatcaccatctaccctcaaagccgttgcattcataatactctacccaatgacatatttgtcacataaacaagaggctgttgttcccaatgtttgccctcaagttgttagttagctgctgacctcataatctgcacagctgtggcatcccaatgtgttgtcatgaaacagattgtgatgtcttaattgatcactttcagaggttacaattgtcaagtgagaccagtgtgctggtctcacttaattctatattaagccttgttacagcaaaactggctaattcattataatgactaggaaatccaatgtaatttgctgcattttatagatttgaacatatccaagactttctttttcttctttttgattgtttaaatttgtggaggctataccccaaccatgcttttattacacaacgaagcaacttcttggaatagcaaatggaatgtaaccccccgcaccatatgcatcttggtgataagttggagtatgccatatgatacacacaatttaaatcaggcattgatttgcatgactgtaagtgaattggaggactcagctaagagtaatggatgtcaggctctgctgcaagccgtctggcaagaagaatattatgttcttctctattgtgtaaaagaaggtaggctcctaagaggttgaggaagggtcttaaatcaatgcgtgaccccaaagggcacttccttgtgcctccattttggtcactggtgaagtcttcactatggcactaacctataaaactctcttttccaagtgtcctaatacactcattcaccttgtatggatctattcccatctggtgcctggaccacctgctactcacattagttgagaaaccttactgtgttaggggtgatgaacagtccctttaataacagagttttaagacaactcataaatgggcctttgtgcattctgcaagtcaagtttttttcaaaagttttatctttgacatttcaaataaacacatgcctttgtcggtctggcacattttataggagtacaaataaaaatgaaatcaaagaaactaatttaagttaatgtaataactgttagcatccaaaatgcaggaggaagaacaagcatgtttatcaaagcacttttttatagtagaaaaaaaaacagataatagctaaatgcccagcagtaggcaaatcggtacatatggtatatccctataatggaatcttgtgcaggcataaaactatctctaagggctgacatgggaaaggctgatgatttttgattaatggtttctcattaagtaagaaaccaaggtggccaaagaatataaatggcatttctcaacctgtctaaaataatatctatagaaaggaaaaaaatatgacaaaaatcggtgtagtgttattgagtgatgagaatatggagaattttttaaatcattttgtccattctttttagtttttgagtttcccatattactttactaattagggggaaaaagtttttaaagcagtttgagtagtttcaattcaataggctgtaccttcagaatatttccagaacataagcggcttctctccatctcctttgctactcaacatggtccacatcactatcctctcttgctgggattgtagcagcggcctaatctcctgcttccaccctggcctcttttttttatcaactttccacacagttgccaaagctgttaaaatgtaactcagctcagtcattcctctgtcccgagcccttcaatggcgcttcatctcacgcaaactgaaagaccccaagtgatttctcccctgctatctgtctggcctcagtacctacttggctctccccactggctctgccaggctacattgctcttcctattcctttcctgcctcagggtatttgcattggtttttgcatttgctctgcaggaaagcttttttcctaaatatgctcatggccaactctttcacttcattcaagtctttcctcaaagattattttctcagcaatgtctttttctggttactccaccaactctctctctctcacacactcacacacacacgtgcacacacatacctcttaacctcctttcctgctttaattttctcgatttagtacttagcaaaatttaacatattatatgggatgatagtttatttattgcctttctcctgcacccaacttgaatataagctctatgagaacaggagtttttgtttatagttttcactgctgaattctaacccctggaactgtgcctgacacatcgcaggtgctctatgactgctgtgagtgcctaccattgataggaacaatggtctgttacagttgtatgatgactaactggttgatttttatgcagtatcttacctctcagtgtagttattttaattcaattgctttcacttcctaacttaaccaactgagcctttaatgtattccagggactgacgggggaatggagttaaaatgaaaaagataggcattgttctgacatagtttactgtctagtggacagacataattaaacaataaagtccaacacaatacataaaacaaggatagtacccagtcgagagaggctactcaccaacaggcacaataaaaattcaagatcgaatgtcagatgcaaaatgtggaatctcatagaagggagatgagaaagatgtatatcaaaaaagcacattgcttctttattactgttttaaaagaaagggtgactatgtgggagagaagcagcaaaagcaatctatttggttgttttaggagaactgaaagcaaggaataacggaaagggcagtgggcttagagttagacgatctagatttgaatctaacactgcagctttatcatctccaagtcctgaaagctgatgcttaacttccacgagtctctattatctccgtggttaaataaaaagggagaaagggacttagactaactatagagactgtctgtgtatataccttcccatctaaaaggaggcctttccttatccatctaggataaacataaacacagacgccaattaatatgatgacttgagggaatctctgaagggtctctgtaatatttctgctagcctgggacttaccttaagtagttactggttctgaaaatctgttttataacctcattgcttgctgaactcttcatatttttatcaattgctcataaccattcatgcatacaggtaaaatacataattgatccctggatatgtttcttttgcatttcctttatagccaccaaccttattacaaagatcaaatcttttcgtattttcttatttcacctgaaattacagttctgaataaaaatatttatcatttagagtggaaaacaaataactattttttgcctataattttaaaccagggcgtggggattatagaaattaaaattattttttgacggtatactttttcttttttaatggaagcatgctgttaacttgataatctgtggcagcgactgtaggtttggtatttgtaggtacttcagagatatttccatatttggtaattatacaatatatgaacttttgttttcccataggaacttgtttgactaagtggaatttactaatttacatgccttctttctctatttttcagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacaggtgagccctctctgaagcagctttattgtcttttattatcttttatgctaaatcttcgccaattccttttgcaggatataaaatgaacagttatttatttacgctgattgttatatgttttgactattatgattacttgataagccagcctgaggtctcatttattccacctatactacctcctgttctttccattctgattggtttgagtctccaagaaacactggatacttccccaaggtatcttttgatctttttttattttgttccatttgctattgattgagttggatttcagctgaaagaggaagcctaaacatttctgtttcaaaacctagtaatggtaaggaactttaggattatgcattaatctaaactcctctgggaattttgccaaaattttacctgagaccacaaacagaacaggctactgattctccaataagattgtgtagcttcttgcatgcaaataggcactgtgatcctgaacatcataacttggtatctaacttgttcagcagaataccatattgaaattatacgtcccttaaaatcattagcagttgaattattttaaagaaatgaggtataaatactattcattcaattatccaaaaaccaatttgcattttttattacatccatgttttttctgtagcattctgtaaactacacttcgcacttttttcccttgaagcctgctttcccctccccttccttctcctatttcctctgtttgctccatttccagctccctcatctcttctgtaactgaattgtgtgccatgttttctttctttttagaaagataactattaaaacagagaaaacaggaattacaaatcagacaatcttagttcttatatctagcgctaataaagaactgttaagggaagatattgaaaccaatagctaaagttttaaattatctgtgaattttgcttatttgtgcaatatcatggataaattgagcatctgctatagttccaatattagcattccaattttttcaaaatgtatgtatttcactattcaatattatcaaatctaagcttttaactatattgagctatgtgctcagggaggtgcagtttctgatatctctggatgtaatttgaatgctgatgattacttaaaaaccttaggtggatcaactctcctttggtaatgtgggttgatctgaatttaacattttctacttctgagcaccaaaaatacacagcttcatatgaaatacaagacagaaatagccatgaaatactagttcctcggactgtatgagttagcaagaagaatcccaagggtgagatttgaatcaatgtagcataaactgtccaaaatgacaggcagtagagatgaaagggataggtatggtgcttcaaagaaaaatggtcatatgtcacattattctatataaatatgaagcctattcacaaagggctttggaaatttctgatctctccttagcccagagcaatgcaattaatgaaatgtattttggtttttcattagttagagttagccctcagggtatcacccagacatacctataagccctagagtcatttgcggggaggtatcagagaagagcttagcatgctgttggttcatgtttttatgtgtttatttcacattgacttttgccgtgagctttgagggagacaacaccatcacatatgtgtaaattgtaaaagaattgggagagaatagctttgggagatcattttcttactggccatgatgaagaaagctgtatcgtaggaaaattactaggtaattttactcacttgataaagttaatttgcaaggtatcattcgattggtagagttaccaaaatgagagttaaagaaacagaaatatggtttcagtttatggtgcattcttatctttttcactgagtctatttctgtctggttgcttcacttagtactccaaccagacaagagaagacaactatgctagtgttttagaaatggacagaatgggtgatttaagtagagcctggttggataataaaatgttgatcaaaatgacctcagaagctgctgttcccaatctatatcctaaccccatctatgttaaagacttttattgtctaagaatttcccatgacaatctgatattcattgtcaaatttcaaactagaatatatttttcaacttttcatgaaggaaaatgtcaaacttatagagacactagtggtgtaatgagcctctgtataaccatcacttagcttgaataattattaattcatgaccagtatggtttcatctatacccctacacactttctctctcaccaaagactatgttgaaacaaatctcagatatcatataattttatttataaatattttggtgtatacctctaaaagataaaaagtcttaaaatcaatacaataccattgccctacataaaaatcaacaattctgccttaatatcattatatatttagtttgcaaatttcccaattgtctcattgatatatttttcatagtttgttttaattaggattagcataaggtttatacatagcaattgattgatatgtgtcttatatttctcctaacctatatagaaacttccctgtctctccttctctcttctatctccctccctgcctgttgttgaaaaaacctaggcattagtcgtacagagttttccacaatctagatttgttaatcacattcccatgatctttctttttctgctacactggtatttatgtattgaggcttggttggattcatgtcttttttttttttttttttttttgccaaaaccattaggtggttcttctctcagaagaaatactctctagttttctctttttttaatgttagatgccattaatgattatttgctagattatataatgtattaggattgcacaatggtgctatttcatcttatcctttttatttattagctgatatattttattaagagtaatttaccctcttattcatttggttaccatgagatagaaaccaatcctgttctcctctttatttaccagttttaatgtattagtttccttgcattctctataggcgtccactattattaatatttacatattgacttacagacttaaacatacttgaagtattttaatttattaaaattatatccttatgctcagattgccctattttggcctatgggaacctcttcaaattggctttgagtccttttgacatgcccttagtagtctttgatagcttctttgtttcctggtattatggaatgtttcaggctttttttgtacatattccgaggcagacctggattcagacatttctgcaaagaacgtcagtttcttttagtagttaagagagcataatattagcaccattgctgctcattgctactggattggtctttgtttcttgggctttacagaggacagaggtagtatgtaaacaatatatactgtgtatattgtttaaagataaaatcgttatgagttcaaaccgaaactttcaattcaaatccagggctatcaggttttaagtttacatcctctatcttatatctgttccttctttttaccatgctgacaatcacaggtctcagagatttcaatgtaattattcatctgctttattccacaacacacacacacacacacacacacacacacacacacacacataatcttagaataagaataacagcacaacaagcaatataattatggtaaacactttaaggatattttgcatcaaagaaaacatttgaatggcaaacatttatgtggatctgtgctcacaaagtatatgttggtaatagtctccaaaaaagaacatttttctcctaagtaaataggagtgaattaagtggtatacatcactgaagtcatgaggaaatagagaataaggggtgtccatttaattttgctttaactgtaaagctattttgtttgatttgcctgtagttattagaactttttagcaagtagttattttcatcatcaagtttttaacagagagacaatgtcatcattattatgtataatttatagaattaaaaatatgtcactagtagttaaagtgattcatgataggaaaatgattacatggagttcctcaaagaaaactttgcttctcagcttgcttcttaaaattgtaaaaatacttaaaaaaaaatatagcccttccgtttaaggtaggcatcttttcacttttccaagtattgtgggttttgttttttttttttttttttgagacagagtctcactctgtcacccaggctggagtgcagtggcatgatctctgttcactacaacctccgcctcccaggttcaagtgattcctctgcctcagcctcctgagtagctgggactacaggcacgcaccaccatgcctggctaatttttgtatttttagtagagatggggtttcaccatattgaccaggctagtctcgaactcctgaccccgtgagccatcttccttaggctcccaaagtgctgggattacaggcgtgagccaccacgcccggccagcattgtgttttttttcttaaggaattcctcactgaggaaacatgaagcagtagaagaaatatgtatatcatttaaatgtcttagaataagtttaggccaactcacaaacatattggaatacctttttgaagcaaatggaatttaatttgctttctttttagttactgtctaaaattatttggcttgtcaattagacagggtgaccttgtgggaaaggctaagagagcagatagagtaggttgctttccctttctgtctttatcttctggggcccagttgttttttttttctttctttctttttttttttttaattctaggttcattggttagtggtcacttttagattgtcacctaccaatatacttctggaaaacaagtattgtgaattctacagaactttcatttcttccagaaatctttgaaattaaaggttttatattcaaaacaacctggaccaaaataccttttcccctttgaatgattggtatgcataaataatactagcctgctgacatttacacatttgcattaatacatcttaagactgaaatatgatggaaatgctgtagggctgatagtggcacattgtgccacacttaacaatgaagaatgtgatcatgttcctggcacacacatatgcaaaaggaatgttaacttttctagagaagcagttgagagccaatgtgagatattctgctttcctatgggtaggtgggcaattgcagcttggatttcactttagaaatatgcttgcaaatataggcacattatttaattaagtaataattgagaaagcgatagtccccattaaaagagcaaagctaattctgggctgttaaaggactctgagctgccctaaataggtcttaattagctggtgccaatgtggctccaccttcagggatggatgaaattaatgaaagctagcagcaaatagaatcaatatttcaagatgttcctgcctcaggtgaagaggatgaaaagaaagggagtcattttcaaagactgtttaggaaacaatgcacataaatcaatttctaaaaacataaaatgggacactgatttgtgaatacagtatcaagatctctacctggctcatctttgccagcctgttccatccattcccactcaatcttaaggagagaaaaagaaatcagcgatgtgtcattcctcactatctttgggggtgacagttttataagctagcaagggttttaagggcagcccaggttttgctatttcagcttggccattttgaaagtttcttgtgtcattgcgtggtcaagtgtagagatgaaattggctctcatccctcaggtttgcaaacctttagtaatatctagagtggaaaggggtttcaagtcttcttccttgaaaatttgggaatcctcttgtaggtccctctgtcaacacacaaggaagccgccttaacacacacagtgtagcttgaaggtggagggcaaaaaccaaaaccaaaataaaacaactatgctagccatatcttagagtcgccatggggtacagaaatgtgcatagtttgcccgaagaaatgccatacctagattccacaaacaaagatgtcaggttattcctaactcagaataaatacctgctaaccccaggaaaacttcgaccaagagataataggcaaaagacagtattaaaaacagtattttccatttttttttcattttgaagatggtctttgcaaatataagtatctcagcactttttcaggagcaatgctgacaaacctctgttagaatgaattaatatccccatcccagctggtgtatttggcaggaacaaaaagttcatgcagcagtcatgggcagatccataggactccttagtcaaaaagcataatactgcattcagggttgtgttttcacgctaacaagcattatgaaacaggggaacttcctttttaccattatttatgatggcattcagtgacctacattaggcctcctctgtaatacaaatgcgctggaaattaaaaattcaaaaaaaaaaaggaacgatctattttaataatgggaggtagggaagggcatttgtaatttataaagatatcagtacaaacctttcatgtgtttaaaaacaccctcatgtgcacacacacacacacacacacacatatacaaatgcactgggtgaaactctgatgtatttgacaagacaatttaggattaaaacaagagcaacatctcaagttcagtgatcatattttaaagcaaaaagctgtgcaggacatcagtggttgtggaaatcaagacttccaagcagtctactgagtgaaataaagttctctgggccagaggatgacttgacagaaggccagattctcagaaaaaattatactgtatagaaaaaaaatcccagtagacatgtatgctcaacagttctctagatgtagtggcttttaaacccccaaagggtgtgaaactcaaaggcaaaagtaggccttaaatgggaagcttcattaaaatgtatacagacttttaaattttatacaggctttaaagggtttatttatttatgcatcatgggatctatctctgtagttgacttacttctctcttacaattatttctcctctccttagatttttttttgacctatgcctccttcttcaagtttagttcaaaattaagacaagtaaggatagttacattcttgtctttaaaacatatgagccagcagcaatctctgttttttctctattcttggatgcttgactctttttaagacagagttggttgttttgaaaattttcatcctatactacgcccatctgtactactagatgtttaattgcttgggcaaatatttcaaaatacctttcactgtgtctgggatgttataagagctctacagatgtttgccgaattgaatttttgcttctctgtaaacagacttcttattagatatggtattactgacctacatggactcctctagttagctctttttctttctttcttttgttcttgtttgttctttctttctttcttttttttttttttgtttgtttgtttcaaggagtggaaagtttaataggcaagaaagaaggaaaaagctccccgtgcagagacagagggaggggtgctccgagcggagagagaaaaaccccatagctccttttcttagtgaagagtaggtcctctagatcagtacagtgcttttcaaactttaatgtacatcaagccacctgctgacccaaatgatttgaggcagggcctgagaattttcatttttaacaagtttccaggcccggccatcctgttcatctgcagatggcactttgaattatgctattaacaaagtaaaagacattcattttttcttgaaccaaataaatacacaagtcaagaatatctgtttcccaaatagctttgtaatctgcttgtagttggatcctaactttgtgatcctgccctattccttagcaaattaataatggggctcagagaagtccttaagaattcaactggagacttgtgtatctgaattgtgtttatgtgttcatttctttcattgaacaacaacacatgtcctaaggacagggactacacccatctccattttattctcagatctagcatagcggtggttagccataaaatacagtaccaaaagaatgtattattttcactctctgtctttcagttaaaggggccatggatgtttcaagtgtccttaaattgacctcagcagtaactccttttctttgttctattattatcactaccactgctctagtttaggccttctttacctcacacatacgtgactgcttatctagtcctacctctatgttttggcagagatagttccctctgcctaaattgcacttccccctgtcaccatgcacacacatgcaggccatactttatgaacaagtcaaatgttaccttttcatgaagcctcttgtaatatccctacagaattcctacttcccctgaaaatcgtagggttatggacttccttgttatagaaataataactttctaccatgcgttattgttatttatgtttaatctcttcaagtggtccataaactatttgagggaataccagccttgtttctccaagcaccttgacataatgcttgactttaataggtattcagtaaagatttaatgggtgaatgaataaataaatggacgagtaaaagaagaaataacacttaatatcttttttaagcttaaaagtccctttgccattgttgaaataccagtgaatttcaaaatactttttttcaacaagaagggtcacagcaatgccaaagaggcaagttctaggattggattttgatagaaaagtttccacagttctatttagagagaccacgtcttactttactttacccaaaggctggcaaatctattaccttctctagggattttgtgattgggcactgggtttttaataagtaactggcagagccattcctcaaatacaggtttccattttagtttcacttcagttgtgaagcaaattccaaggcttcactcacaattctgttagctgtcagttgcctggtgagaaagcaaatcctagtacccaaagtcaaagttatactcttgggcttcaggaggcaaatataagcaccaccacagaagtcagaaaacaaaatacccaagtaaaggagaactgaaaactctcataaaacaacctgagcttctctaccaaactttaaattgccctccagaaaatattttcttctttggtaacaaagaaaataaattgccttactttttaaatgccttcatgatgaacataaagaaaagaaaaaattggtagttgtgtctttcaaccaactgcataaatgaagaataaatttgtatatagactaagaggaaaattaatgaaagcatttctggcatattcagatcatgtcactctcctgctcaaaatcctgcaatagtcctccattttccttagaataaaaacacgtgtttacagtgacttccaatcacttctgatgagtctaccatgatagcatttaaaattgaaatccttacctcacatacccagcattcccaattttccttaccttgttctattttatttttttctcttatagcattaccttctaacattctatataatatacttatttattttaatttttagtgttttctatgtatttctcctactgggatatgagttctctaaggccaaggatcattgttttgttcactaatatatctcaagcacctagaagaatatatgttgtgtagtagacactcaatatttgctaaataaatgacctagaggtggaaaaacaattgaataaaggattcaggcaaacttgcaaaaagttatcatgggggtctttaatcgcttaaagaaaaaaatgcatccactcagaaacagtgcaattaagttacaagtttaaggctgttttttctgctgttgttttacaaaaaggtgctagtattgaagctgtcttatccaagagatcatcattgcactcaaggaactggtctgactgatttttattcttcaacacatggaccagttgtttaaacagaattgatttctgatttctttggtatccaggggaaacagcaaaaatgtctcattcttatttggattagtagaacagcggttctcaaacgtgagcttgcatcagaattacaaggggtgctgattaaaacacagattgctgggctcattcctggactttctgggttggtatgcttggattgaggcccaagagtttgcatttctaacagaattccaggcaatgttgctgctggtcctgggatcacacttcaagaactaccgtgataaagaattctaagatatcaagtcacattcaattattttgaacatttggtcctataatctttattctattggcatattgttgcacgaacatctagcactatttttgttatgatatttttcacggcgaggagttttttaacctcctgtgaaagtcctactgcaactctgtcattttattcttcactttcttaagatcttgctcctctgtaattataccagatggtgctgctcagtagcttataagggagtgatgcttcatcattctagacagagagacaaatcactctgttctctgacttttgaatcaagaatcaacatttgtgtgtatgttcaacctgctatttgctttgcaattttgctcattaggtatttattaccctgacagtgtatgagttagtcattttccttctgccgtgtagttcagattagcactgtttgacaactgccatcatcacagcattacctccaataatatgtaatttcttttttgcctatgttatctgggtgaggtagttatctaggaagtatatctacaaacggaagatcacaaacagcattcagttctctgacttatcatgttagaaatggataactagggccatttccttggagtttctagccctgcgattggcattgctgaaaagaaaggaatattatgaccaaagccaagcgttctttttcatttattgtatgctttttttatgaagaaggtggtatgagggaagcatacaatttaatgagaagcattgaaaaagaacagaaacatttattaagctctactggcaaaatggataggcaaccctttacagaaacatggaaaccatgcagagcagagaactggttaaaatttagaatgtggaaaacagtcttatctgagatattcaacaattggagcaaaaacatattttctttttctttataatcttcactaaaaggagaactaaagttattactagataactcatgcaaaggcactattacaggcatgtaataacattcttctgacgtgaataggttgtttattctctcctaaaatacttctctacacagttttaatattaaacttatgaaattttcttgaacttttgttgattggagggtagtagagagagaaggggatatagttgggagcttttgggaaggattgtcaatctatcttaattcttctagttgatagtagatttttgaccattaaatctttactaacaaaggtgttaatatcctcgtaatgaaatgagtgtcctacactacatcagctgtatcattgtggaggtacaaaagctccgaaggtaaatgcaaaacaaagaatggttgctattccaaggtgactttttcatgacatgttctatatttctgatatgtcttctagtcttaacctgtgagttcatagcaaacacagttggttttatttaggagtgcattaaattttattccattgagcaaatttcacttttgcttcatagtgattgtaattaatttgctctttatcttctctttatctttacttcactcattactcatctgacagctcgccatcccatcttaattgggagagaagacccttccaaaagtgaaccattggcagttctgtcatctggaaagagatacataaaatgtgttaagaaacagaaatgactatataactggttcatcatatttccttagcaggtggattcttggtgggcaaagatcatgttcctggtgcttttgctgccaagcacattgtgggtgttcaataaatattaaataataagaagagtttcctaattaagatgaacatttttctctattaagcagatggtgctcaataggagtaacccattatttataagtatgacacaaggtgctggcaattgttgaggaaatgtggctctcacttcagatgctgattatatgttaaagcaaacttttgtgacaaacagcttggtcgatattagttaatgtttgtgattaaaactgttactaaagatggacttgtgtatgtaggtctgtaattctgctgttttgattcttaatattggcttcacctattcaagtatttctggctatttgatgcaaggcaagtttgggcaaatcagtgtatacctgattttaccccataggttcaccatttgatttgaattctcatccttgtctgatttctaaagagatttttgttttgagtcctttgagtctctttgtggttgctaaagctagatgtgaacacctccgtgatatttgcaatgcttatattcgtagctgaaatctcagtggaactaaggagagttaattaggcattcccaaaaatacacatcgttttatgattttgcagatcaccccgatgaaaataacagtttaattttgtcaagtcatgtaaattatagtgagagggatgatgagagttctcagctctttggagaagttaattttgttgtcagcacatccacatttcaaaaatcacaaactagaggcagaacttttcagtgccagtgagatttggtgatcagatactgttttcatttctaatgtctgccttctgtatagcgcctatgcaaataggggctttcaaggatgcaaaagtagcaacttcccctattaggagcgtaactagcagctgctgtgtttctcataaaagagaaaacatcctgtttactaacatacaaccatacgccctcacccgcgtacactcacaccaagctctttttttaaggcagagcttttattttggtttgagataggcagcacagaaatgcagtcttttacaaacattccttgagcacatatcccctgggtgctaagtaggtgtcagtcattgttctagatgtggggaatccactgatacttgaaacacattctctaattttactgggaactcgtcggaacttctgacattcattggcaagttctttgcatctggtctcacctccttatttttaatatttataaaccatgttcatcaggatgtcagtagagaagaaatgaaagtagctgagaaaccttgccgagagagaccaaatctcaaagtgaactaaaaatgtcttgaccacaaggatagaaagtgaactaagatatgttcttgaggcagcaaaaataagtattgtgccaaaatccaggctttacctcagtgtcagataatcaatggactagagatttcactgtgttgcccacagccctgttaagaaatcaagaccatgtgctttgtctataatcctggagtcagcccagaagatgagctcataaatatgttagcttaagtaaagtttatgataatatagacgatgaatcatcttcctgttttgaaaagcatatattctataactcaggatttctggagtccctccagaaatctacatgacttttgccccattttctttaggtcttgattcaaatgtcgccttataagagagcccttttttgacaacactctcccacccccaactctcccttttctgcttttcaaactctattttcctttatgttacttgttatggcctgatatgtgtttgctattttctgtcttcccttattagactgtaagcaccatgagggcataacttgttgtttacctctctgccccctcaaatagcatctgacacacataggtgacactacccagttgttgagtgggtaacatgaggttgtttgggattgttagttcattatcctaggcctacacagggtcagcatcaccaatatcgctgtcttccaccttcacatcttgtctcactggaagatcttcagagacaacaacatgcatggagctgtcatctcctatgatagcaatgccttcttgtggaatactgcctgaaagacctgcctgcagctgttttacagatatatatatatatatctgtacatatatatatatatagggagagagagaaagagagagagagaatgccctctaaaataatgatgaaaaataaagtaaatacataagcctagtaacatagttgtttattatcattatcaagtattatatactgtacataattgtatgtgttatacttttatatggctggacatgcagtagtttacctaaaccagcatcaccacaaacacatgagtaatgcgttgtactatgatgctatgacagttacgacatcagttggctataggaatttttcagctccgtttataatcctatgagaccatggtcatatatgcggctcatctctgactgaaatgtcactgtgtggcacatgattgtttaactttcatgagagattctgataaccaggggaacattgaggtgatataatttaatccaaaaaagtagatgtttcaaataagattttgtattgggtaaataaatgattactgtttggctttttggaatttcatgcatagctcaagaatctctgttgccaacttcatggtctccttagtggtacagagatctcagcaaagaaactcagaagtgagcacaacacacttatttaatgggtaaggaaacctaagaccagggcaaatctagtgactttctcaagtcccacctcttgtagtgaaacttcattcatggggtcttatgaatcctaggctagtgtcatgtttactggctcacaaggactgccaccattgaattgagcaccaggttgagtatttctcaaatgtgctctggggaccatctgcttcagaatcttctggagggttctgctagaaacatagcctctcagccctgtggattcagaacctctgggaatggctctgcatttaaacagttccccaagtgtgtcttacacattcctatgcctggagaaccagtgacccaatatgtgcaaggattcttgattctcctccatggaaaaataaaaaaattaatcgtatctccaaactatatgagtacatatctatcgagaacctggaccaacagtttttcttggggagggacactggtccatattaaaattaggttagttttaccatcaagttggataatatgagctactttgaacttttgggcttaaatctatctagttcattaatttctgccacaaaatttttaagtgcacattgccaggaattcagagataactgagacaaccccattgcagttgggggagacagatatagtttcacagggctacagaaaagccccgaagggcctgtcttgtctccatgtgagacctcagaaccatgtaatgcaaccaaccttagttgcatagtaagtaaccaaccaggtgtgtatagtaagctgcattcctaaatgtctttctatagttctggacatctctctaagtccaccaaatagtctcagtcttcacacaaagaatagtgaggagatctgtttattctcagagttagtggacaaaagcaaatattctattagatgttattagtattattattgttattattttcaggacctacatccagccccttgttgccataatcgctatccaatcacactgcccttttcctttgttataataaatttctcccactcttcatcatctttgaggatgaatcatacggttcatcagcatcttacttcctgacatacaaccctgaaattgaacaattcaaaaaatttcccagaaatgactttgtgggattttaatctaattctctgaatggtgaaaactctttaagacatttttcaaaggccaggtttttaaatatttcataccatggaaactgtcttaggaaagagttggggacttaaggtcacaaaaaatgagaaaaattatacttgagaaaaccttgtaaactagaacttcttgtaagaatattaatatgttatttttatccatcttaaaatttcctcaggcgtgtgctgaatgagcctacttcatggttgtagttttgttgttctttccacgttattttgcagttctccctgtggccatcatattgattttaacactgtggtcatcattataggaaaatggaggcattaataacttggtctctgtggacagattgtaatagaaaaccttataaataattgcccactaatgggaaaattgaaaatatgcactgtattataatggtcataatgtaatcattaaaattataattatgtgacaatgaaagaactcattatgcattagtttatctttacataatgctaatagctaatgaaagtgtgacaattagatctaattaagtttaacaacatttctgcacttctcgtaaacaggctatgttttgccagaaattgtatatgcggagacattagtgataccgaggtccatctcatataatatgagttttgaaatgtaaccatcagtcctatgaagaaccttaactttataatgcctttttgttaaatgaactggaagtatgagtctttactaagggtagctttataaaaaagtttctcagattgtgtcatgttttagttaaaaataacaattagtccttcctcttctactaatctgtgcttatatatttgtgtgtgtgtatgtgtatgtatgtacttgactcatctgtgttttgtttttaacaatagaattgttatactgaattctcaagttagaggtttgattgattgatgataatgaatcaagtagatgttggtttcttgtcatagattatagcatataacagtccaccatgtcctatctgtatgatctaggtcaagtgtaaactctctgtgcttcagttttctcatgtataaagtagtgtctatacttttgttagaattaaactagaaatttataaatttcttagcctgggcatagcacatggtgctagtatttactattattagtaggaattattttatatctatatcataatatcaagaagaattccagctagtatcacttttcctccactgacattttattgcattgcacatttagataatcatccagacttttatttttccatcatttagaaaaatcattacatacatcatattgaaaacagtatagggaccttcaatatgtgctcaacatattcttcagagtggagttttaagactcttgagcactggaagacattggccttgtcaccagggtttccaactgctcaggtttcacttacagaatgatagactgtgagctcaactatgaatgactcttggccgctctcatcagtcttggatcatcaggaagcctcagaaaacagagactgttcaagtaaatacaggtagaaattggcaaactcagtcacttgctaccatgcttccaaaaagccatgatactggtctttacttttctaccattccttttattgatatatgttcagtacaaatgaaacattctctccccaagaggactcattcacttccataagtcaaccatcactgctacgtcttgtctccatctctgctatcacttctaaacattggtctctaaaactaggttggcctttaggcattttctgtgtgaaattcaatctgtttaaatttgacttatctttcctaacgaaaatgtaattgagttaccaagtccacagtcacttacttcaaaatattctttgattatatgctttgtttctatctcgaggctctcattgtctcaggtctagactatgaaaatagtctccatctattctcactgctttccatcttttgcccttcaatctgcattttatacttccaccagattaatcttcctaaatcacttttacatttcattcacctacccacaaaactctgatggttcttcattgcctttagtttcttttatctggcattcttgtccctcaaagaattttgtccagcaatttttctaagtttgttgccaactagtccctacagttgttctctggcccaaccacatgggtctgctcgttatctccagatacacattctaagctttgcatctttgctgaccctgtttctcagctgaaatgctgttccttttctactcttgtcaaataaatcatttaaggcatagctcaagagttgactttttccatgcagctctctctaacagccccatttatccctccctcctacgaattcctcaagcatttatttttctcgccctgtatcttgcacttgtacaggctagtttggctgcttcttatcttttatgtacagttccagctggccaatgggattggcaatattggaagcccctcaaggctgttttttcatctctctgtgcagagttctcagtgtatattaggtccttaacaaatatttttttatgagagtgtcaatttcgtaagcacttgaagatagtactaaaaagccttcttgccacttggttctgcctggagctgatttcatacttacaaagtaatgatttctgagccttctgcttatagaaatcgtgtaaagcctcttggtagaatgaagcatgatgccctctaccctgaactcaaagacctttttgggaaagtattattttagctgagagtttaagggagaggacagacagattcctgtgatgcagagatcagcatcacagccctggcagccccctcctcttgctgagaacagctgtttcaaatgcccattttagaagggcccttaactttccttagggctgctaagagcaagttctggatcacctgtagctgctgctgcttagataaccccagaaacaaaagcaggtgaacactgggtatgcttgcctcaactttgccactaactagttaagcttgggaagccagctcacttccaacagtctcaaatgctttatctcctctgccctaaagtgggtgaagagctccagaattaaaatttgataatttttactttatttttaaatcaaaggtagctgaaagttgaattttgattaaaaaaataaaattcaagacaaatccacctgaattttgtagctcttcatttcatagatgtaaatctatcacaaattatcattctgtctttctttctgtctctcagttcctctccctttctgtctctctcatacacatgcacacatatacacaaaatattccataaaatcagtttttaccagaaatctctttcatgctggttctcctctatgtagaaagagctacaaatgaaatggaacatgggaatagaacaagaagctgattctcttttaaattgccttatttgttttttctttgggaagtccgaatttttgaagacttaatacaaccctgccccaatataaactgtctctcgcattattaacatcccccccgcccagagtggtacatttgttacaactgatgaacctgcagtgacacatcattatcccccagagtccacagcttacattaggcatcactcttggcattgtacatacattctatgggtttatacaaatgtataaggacatgtatccaccattataatacagaatagtttcactgtcctaaaagtcttctctgctctgtctattcatccctctctctcccctaacccctaacaaccaataatctttttactttctaattgttttgccttttctagaatgtcatatacttggaatcatacagtatgaatccttttcagactagattctgttacttagtaatattacactcctttaaatttcttacttattacacccatttaaagttcttccatgacatttcatggcttgatagctcatttgtttttagtgctgaataatattccattgtccgaattgtaccacagtttatttatccatttatctactgaaggacatcttggttgtttccaagttttgtcaattatggatagagttgctataaatatctgtgtgcaggtttttgtgtgcatgtaaattttcaacttgtttgggcaaaaaaaatgttttatgttatacgctgaaaaatgctggctgaaatatgtagctaagttgcctttattgcctttttttttttttttttttttttttttttgagacagaatctcactctgttgcccaggctggaatgcagtggcacaaacatggctcgctgaagccttgacctcctgggctcaagtgatcctccctccgtagccatccaaatagctggaaatacaggcgtgtgccaccatgcctggctaatttttaaattttttttgtaaagacagagtcactccatgttgcctaggctggttttgaacttctgggcttaagtgaccctcccaccttgacatcccagagtgctgggattacaggcgtaagccaccatgcccagcctacttttgtattctcttataatgttgagtgacttaccttttgggagttatagatattagatacaacttgaagtctttttccttcatttgtaccatcaaaagatgttttcggtgttcaatgaaaattgtttcaaaaggaatttggcagtccccaggcttctacaggcggttttgaggatgaaatgtgggggcatctccattctcattatgttgatttctccttgtgacaaaaaccttttgccaccccgcctgcttcccctcttgtgctctgtcttttctctcctctttctttctgctacctgctcactctgttttctctgtatctctttgttctttctcagagctcttgcctctgacacactttttagtgccatcgttttttgagacagcctgatttgatcactgtcttttctctctccctttgaaagctttctctgttctgtgtatttcctagattactggtgatacttgtcattctggttagattttgttcctgttttgatttcatttttccgtaagatttttgtttggttgattttttttaaccttaagaaaaaaagagatttttttacttgcattccacttttctttctgttctgctctgtaacgtgagtgtgcaatatgctctaaagtccaaaaggatagttaacacagtgggtggtggggctatgcataatttctgccatctttcttatagcattctgttttctgaaattgtttcatggtgcatatgtacacataataagaaagaaaaagcaatgaaacgatttctattttgacaaggaaaaaaatcttaatgagagcctggctttgggtcttgcctctagctctccatgaaacctttttcttatctgtcttcaccaccaagcataaccacaatggctggctgagctggagatggacagcagtctgtggggattgtgtaagtgatccaatggttagctggaacctaccaaactgcaagtcatgggtcacttctgttgattccccaaggctaggctcttactgtcaattgttactaaatggaaaaaaatgcagagaaatagcactgactgccttatgaaatctagtaccctttgttcaatatgacaattagttttgaaagctgctgatgatagcagacaggggtgacatgtgataatgcttattcattatggtagcatcacactgtgattgcagcgtttactttttatctatttattcattcatttatttattttagcattcttattgattgctcttactgattactgcatgctcatttaagttgcatgacaaatgctgttatttgctcactcctcacagaaggcttcgaaaagcaaaccatggcaggtcacccagaaaccaaggtggcagggcactgaataaaatgcagccccccagattttcttccaagtggtgtaatcgtaaacatgggttagctcctttctaaggtggcaggaatcaaagacagaggtaataaactttggccagagaggaggcctgtttttacatgcttgtaaagttgtttttacatgcttgtacaatggagtgtttaaattcacagtccattgtgaacataggcatggtatttcatgactataaactgtcatgttttaagcactttggtctgtcaggctaactaaatataagcccctgtcctaaagaatcaagctcacatagtatgacaaatcagcattttatttatttgtgctaaaagcatttattgaacagctgtgtactaaaaatcctgcaacaagaagtaacattgaaatttccttaaagagcttcttctactgaggaatgtagacatattaacaaataaatacaaagtaggattataaaaaagtattttagaagaggtagctatttacaggatagagtaaagggagaggttaaagttaaaaagttaaattaaactattttttattgtcatatgaacaaaagtatcttcatgttaaattaaatacaattagctgatatttgtatgcatctgctttttatgagctgtcactagaagatgactttttactgcctttttttttctctgttttttttttttttttttttttttgagacagggtttcactctgtcacccaggctggaatgcagtggcaagatcttggctcactgcaacctctgcctcccagattcaagcaattctcctgcctcagcctcttgagtagctgggactacaggcatgcatcacgaggcccagttaatttttgtatttttagcagagacggggtttcaccatgttggccaggctgatctcaaactcttgacctcaggtgatccacccaccttggcctcccaaagtgctgggattatatgcctgagccaccgtgcctggccaccattttatattttgataattcatatttagtactctcagtcacttagttactcaacatctgagtttctttatctataaaattgacttaaacgtctatgtattcaatattcaaaaagtatattggttaggaatattttaaaatatacaacaaagaggtgactatggaatctaaaatcaatttgagaatacatataaagttaaaggtattataattcttattagcttatatgtggggaaaacaaatgattaaatatatgcatgttatgaaagaaaaatttatgaagtaaatatgtagaagctgcaaatggtgagaataatccagtgtctcctttttgagaaataaggaatattctttttcatttgctagagcaaaggttaaagaaagttttaaagacttgatattcctgtatttggatagatcatagataatcattgtcctgaatgctgagtaaacaattgaatacatctaaaaatgtgacatgcattatgctgagaccctggtagtactctctctgaataatgttatttgggcagagctaaaatgacttaactgtaattcccctaaaattaatgtttcttttttctttctgaaaaagtagttttcataggatttagacaatatttcagcataacttcaaaataataataaatttgatgtgttcatggttgcattggtaattagtttcagctgataaatatctgtggctcatagagaatagcaaccaacaacagacctatccccttatgcttcaatcttttctttttttatttttttttttaatgttttatttccataggttattggggaacaggtggtatttggtgacatgagcaagttctttggtggtgatctgtgagcttttggtgcacccatcacccaaacagtacacactgcacccaatttgtagtcttttatccctcactcccttcccaccctttcccccagagttgcttcacccttttctaaaactctttaatatggagtaaaagccaaaatcactttttttcatttttaaaacacctttgaataaaatttgtaatccaatctcttttgtattaaagcattcgaatgcaaaaagtgtaaattttgtctgtgtgtgtcagtttgcaatttcctaaactcacttaagctcaaattgctaataattaaatgagactgagttcgaagatagattaaaggacagctgattgaggatggcagtaattcctaaaggacccaaaagttcatcagaatatcacatttaggaaactgctggtcattaaggtgttaggttgtgaatttgagcctcaatggatgctgctttcttttagaatgaattaccaggtggttattgaggtatactgagtcaggattttttaatttaatgagtgctgtgtaacacttaagaaatcaaggccaacatttttattttttacctgtttgtggtgcatcagccattatttaatacattaaacattggaaataagatcttaaccaaaaatacagattttaaccaaaaacataaatgttggggctttttaaagcatttaatgaatccttagttttgtaccaggtaccgtgccaattatttttcttacattatatcatttaattcttacaataatttttccttcatgaggaaaaatatcctccctccccttacaaggaattgagacatagtgatgctgtcttgaatgctgggtaaataactgaataaagtcacattaagtagagtccaaacttagcttcatttaggataatattcaacacatttggggaatttttttaagttgttcccattttgaaaactgacataactataatgtcatcatcatttttaggaaatgaaccttggcatatcctaggaattttgttttcaatctccaatccaggtggcattctggaaagtggactgttactctgaccagacattcagcctgggtgagctttgctgtacactcagctgacctacttgtttaagggtttttaaaactcctgtgttgacaatagtaagcgtgactcccctctgtgtacctgtgatcaactgaatgtacaatattacaaaataagggcttcttcttggtttctttatgttttttccttaagtcttcacatccttaaaggaaatgtattttataaaattaagtctgaacgagaaagcaaagccccatctaacagaagagatcgtgtccttggaagatgatttcttcatctcagctttctcaggtctctcgagatatttattcatagccctcctatggaaacacagggttctcaatgtgagcagctctgttaggtttcatgtcattgcctctcagcagccctgttcagtaagattttcagtgtctgattgttcttataatcaaatgtgcttttccgatttccaaggtaaatttgctttctaataaatgtaacattcgttggtgcccaatgaagtcttttttttttaacttgtcaaattacttagtacagaaaaatagctataattcttttctttcttttttttttctcttttttttttttttgagacggagtctcgctctgtcatcaggctggagtgcagtgacatgatctcggctcactgcaacctctgcctcccgagttcaagctattctcctgcctcagcctcctgagtagctgggactacaggcacgcaccactacgcccagctaatttttttatttttagtagagtgggtttcaccatgttggccaggacggtctcgatctcttgacctcatgatccacccgcctcagcctcccaaagttctgagattataggcgtgaaccaccgtgcctggccaaaatagctataattctacattaataataatattaatcattttgtttcatttggaacttttttcaattttgcattttctcaatttcttaaggtcgattctaagaatttacttggtaaatcacaggttctcaataagtattttgaaaattaacgtcaaaataaaaagaactgaacactccaggtatagagaagggttcatttaaacttattttctctaagatgatcgatcttctacattttttaaatgaaatgagatgctataaaacaacatattctgactttttttttttttcagtgagacagagtctcgctgtgtcacccaggctggagtgcagtggcgcgatctcggctcactgcaagctccacctcccgggttcgcgccattctcctgcctcagcctcctgagtagctgggactacaggcgcccgccaccgtgcccggctaattttttgtatttttagtagagacggggtttcaccgtggtctcgatctcctgaccttgtgatccacccgcctcggcctcccaaagtgctgggattacaggcgtgagccaccccgcctggcccatattctgactttttaatagattacttaattatatttaattcctagaaacctcttcaacatccttgtatgagattcacatctgtaggttctgcctttcttatataaggtaggataaaatctttttattctttctcttccattcttctctttttatatcttttggcaccttgtgctctaatataagaacactttaagcttctcttcttgcctttatgctcctgaatacgttttcttctacctataattccagttcccatctcacctcctcagtacctctcctctgagccaaatctggtgtttccttgatgctcagaaatggcacctcctccacaaaccctccctgctatgcccatgtctaggcagaatatttccttctttcctcagggctgttacctttctggagtactggacaggatagttattaaaacaaatggttttttagtcaaatggttatttgacctcctgaccagctagaatgtgagctttctgaagagcaaggggcagttttattctttttgtgtctgcaacactatgctcaataaatattaatttggaagtgagaaaagtgatgttatgatgagttaaagttttcatggttcactttttcttctttgaaataaggactcaattgttcattgctgcatacctttcttgaagcctgaagtagatgttgagatgctgtctttgaaaatgtctgaagatttttccatgataatgtggagactctctacctaaactgttgtccaggataagtgatctccaagggagggcatgaaatggcacatatcactggtttccctgtgacagctgcaggaggaacaccctggagtaatggtgcagtggagagtctttgccaaagagttactgtcaaaactgaactaagctgttccaagaggctcttaactctccctaatacgtatggcttaaaataaaacgtggtgtatacaaatgaaaaaaggaagtttgtttaaaaaggtccggggctttgaaaagctatgctttatgttttcaatttaggagtgtataaggcctttggttattgctgcaggttgaagaatgtgctttaacaaaagtataccagctcagaaaccatttctgtcctctcatctacccactttcctttccattcaggtgccactcaacccattttggcaaccaactaaagatacaatagcatacaccctgttaggaaaatctgtagaaaatgtagctacagttttttttatctgggttcatgcagttagtaaacactagttaagcacagactaaatgtaaggtacagtgctgggcagtgaggactgaagggcaaatgagataaggagcttgtcacacaccagactgaacaagtagcaaatacaagagtctacagtagaaaagatggcagaattagttctgactgatcagaagcagcttccacttaccatcagtgtcactttgtacacattaacctctatgtgcctcacttttctctttcataagtagagatgataatactacctcataggattgtagtaaagattaaattagtttatatgttgttataaacgtgtttacgtatgttacatgtagtaaagattaaattattttctatgttcaaacagaccctgacatctagcatgtgcacaagagaatataattatatttcgttttacaaaagatattgtggactttttacaaggcaaatggcaaagagcttcctaggcagaggccaataacctgagtaaagagacgaagcatggaagtatgaagtgtgctgaaggagttcagtgttgctaaaaatttctttaatggaaaagagtggagagatgtcctggaaatagacttaggtgccagatcagaaagggcatatgtgtcagatcaagaatttgtgaccctaatgtttacattttcgaaaagtaagccttgtggcaaaaaatggagttttgtgaaagaatgtagccatggagctcagtgactaactgcttattataacagcccaagttggagatgatggggccagaatggggacatgctgtccatgtcgatgacaacatgaactaggatttgaaagcagagattatgccaagggcaaaatatccactgcaggtgtatcctttcccttttctagaaaatagaactgtattttgtagaatctttttgttcttcatcaaactctgtttttagacttttaccttcaaaccacccaagaacattagagcctcataaactataaatgattaattttatgactcactatttaaagcaaatggaaattttaaacttgtttttatcatgagagtccctgtctggcaataattgggcaaagaaggcaagataaaaaacggatttttcttcaggatctgctaagtagaaacaacaacatagaggctgggcgcagtgactcatgcctgtaatcccagcattttgggaggccaaggtgtgtggatcacctgaggtcaggagttcgagaccagcctggccaacatggcaaaacccagtctctactaaaaatacaaaaattagctgggcatggtggggtgtgcctgtagtcccaaccacttgggaggctgaagcaggagaatcacttgaacttgggaggtggtggttgtggtgagctgagatcatgccactgcactccagcctgggcgacagagtgagactatgtctccaaaaaaaaaaaaaaaaaaaataagagaaagcaacatagatgctgaactttaaggaaatgtgatataatatggacttgctcaacataaactattgaaaaatgtgtgtagttataattattattgtaatgatcataaatatcatttactgggcccttactatatgtcaagcatatattatattacttatgtaacgtgtagtttattacctacattatctcattttgtcatctcaataatcctatgaggcaggtataattattgtcttcattttacaataaggcaagtgaagctcagaaagattatgagacttgcttaagctagcagaggaaggaactataggaaaaaaatgtggtcaaggcagaactccaacccagatctgattttttttcatttttaatttttatggagagatagtagatgtacatatttatggggtacatgagatgttttgattcaggcatgcaatgtaacgtaattacagcatgatgaatagggtatccatcccctcaagcatttattccttgtgttacaaacaatccaattacactcttttagttattttaatatgtataattaaattattgactatagtcaccctttattctatcaaatagtaggtcttattcattatttctaattttttgtacccattaaccattcccacctccccccacccttccaccagatctgattttagagtccacacacttacctgtcctgcactgagagcacccaaaaacattagcagcaaatctggttctttctctggcccagctccctgaggacacatattaaaaggataagcttctttgatgtcagccacaatcttcaaagtcttttaatttctctaaacaatgagtagaaggtctctcatgcaggaatttatcagaggctttgtgagcttatttatgttcatccactgtaataaatactagtgtgcaggtgcatggggcaagtagtgcaactgagtgagaaaagaactcagaaacatatgagaggctgagaccttgaattgtgtgtcctgagtcaggtaaatttatctcagttgcagtttccccttccataaaatgagtttatgtccatttccctttataattcaatgattagtcaactctaaattttgccacctgaagtgtatctacagaaatactccattccagattgattcagtcctctacccaaattgtctcccccatcagttgatgtgtatgtaaggactacacactaattttcacatttccacaagcaaaacacaaaggtaaacctgatgcctcccaagtaatgctgtatctgctatcaccaaacataaatgattttctgattttccactcttttggaatatctgcatcactgttggctttcattagcatgacagttcagaggtgattgtactaaattttactttgtacacatcctagtggcaatgtatttgtgctgtgatataattcatttcatgatttagtgagtcatgatggaaaaaagtattaggtacttctttttctcaatcaaccaagaacacatcctactttttccatctgttcccggcaacagatgtgttatttgacaagaacccactgatttgtaccctgcctggcatattagactcataccactgaacaacaaggtacctggcttagtgggcaccttggcatagtcccttttaggacccctcctttggttttcataaacagaatgttactgccaatcataatatgtattttgtaatggaatttaagattcagagatttgagtagaaacaacttagctattcctcctccatcagactcctgctggatacagccctcattttctcacacgtaggactgataaggaagatcaaaatggtctcctactgtgtttaaaatctttacttttcactctttaaattactggctttctgtaacttccttctgtgttttctgacatctacagtttcacaattattattcttcaagatttgtcttccttgaagtctccatttttgaagtctgggaggagcaccaaacttggttttattccatcacatttagtgatagacttcttcttctgttttttttgttgttgttgttttgttttgttttttaaagacagggtctcactctgtccaagctgtagtgcagttgtggtggatcatagttcacagcagcctcaatctctttagcttaagccacccttctacctaagcctcccaagtagctgggactataggcatgagccactgtgttatctatggataaacttttcaatgagaagatccaagtatcttggccaaaccaaagccaaaggcagacctctaatgaattcaaacagttctagggacagcttaagataaacagtgtgatcctactcggccttaagagtgaggacgctatcggttcattcagcccagagctaggaggagtctgcttcctgtctgcaagatgctattgcagggtccaaggcaggatttctcagaattgttgactggagcagggaacttgtggccctttgtaattcctaagcatcttcctccttttctaccttgccctcatcaagaatcctaaaccaaaaagtatttggctaaagtgtgaaggagactgtgattctgctttcttgaaatttttcaagttcttaaagcacacaatatgaagctctataaaaattatttatgatttcaaaagaaaataattttaaaattaagatattatgatagaaagtagccttctagtcttgccttaggcatgacaaagaactcaagttcccacctgagagagatggtgagaattgtacttcacataaatactgtttactttcactctctaggaaactctataatgggtgccatttggcattctaataactgttagtgcagaaaatagtgtttccaattatgtgttctcaacacacattttcattagagtagttggaagcaaggtttcaggtaactggaattgacctcttacttctcacagaattagaagtcaagaagttggcacctttctacagatcaagttttaatttatgacagacttggtcaactacctggctttactgtgcctacactctgagtttctcctctcccagtgagaaaactgatagccgctggcatggcaggcggtcttccacatttatctttctaaaagtgcaccaaactatagagcctcagagttagattaagggatactagaaaatcctttctcaattttctgaggctggagtaaagacatttttttctgtactctacatgtgttctcaaattctcccagatggctcctataacactggtctagacattcacttaacaattttcactcagtaccaattctggacctgacactgtgctagccacagagtacagtaaacaacaggcaagttcatgaaacactgtaatgaaactggagaactcattttggttttttccttaagaagcaaattaaaacgtgaaaaagaataaatgagaaactaactggccaacttgtaagtagagattagtttttctgatgcttccttaacatcctaagtacctagggatgtcctttacatgtcagacaccattgagtacctagaacagtgtctggactctggtagggagccactgaggtaagcccttctccactttccatagttgcttcttctctggagaaggaaacagaggaacagcttctaacagtgagaagagtaacattaaggaaccctctctgctctcttgtagccagattgcaactgtatgtcctctccttgttagactgagccaggactcccttgcaagggccccaggcttactctgtaccctcccagccatccctggcttggaagattttggtcatcaatctacatttcatatgcaataactttctcatttgtccatttccttaatcaaaggcatataaaaatgccaagcacagctgctgatttgtctgaaataaccagtactgactagaaagttctagtctaaagcaagggaacattatgtttgtggttagtatgtgcaacctcataactggtaaatcaagaatttccattaacatttgtcagtagttttatgactttgtgacaacttcagagactactgagaaccacttacgatgcaacttgggagtgtctctactaagaagacttccctgattcccatgctgggccaagtgtatccaaacactctgtatataacaatcttagtgttcttggaagtgtagtcccagatcagcagtagcagcatctagcatctcctgggtacatgatagatatgcaaatcctcaggtctcaccccaaatctgctaaatcagaaactgggatgcagacctacaatctttatttaaatatgccctcacagtgattctgatgcacactcaagtttgagaacccctgcatcctattaacaaatacatcatgttaaaactattatgtgtatgtgttgaattagaagttgtttgagagcagggaccatgtattcacagtataaatacactgtgtatgggtgtgcattacacaaacagaacgaaacaatatgtactattgtgacatgcttttattttcttccagcaatattttgtgaaaattctttattttgcatgcatatattttgtgatatggtatctgatggctgcgtagtatcttactgtgccagttacatcaaaatttctttgatcttctagtataggacaccataaagctctttttaaaactagcttttattttttatgaaaataatgcatgcatgtacttaaaaatctgttttaagtagcagcccactccacccctcgtcatgtcttattcttacttttagcagcaatcacttcttggtcctttagctgatactatttatgcccatggttctaaatgatatacatatacttctgtgccgtttcaattttagacattatctatgaaattcctgtgatgcagttgggaatttatctctctcatgtctctcaacaccttctttttcagtcttcccaatatagctttatcaaatttttggttaaagcaaaagttcagtgtttataactgtataaatattattccttgtacagccaacaatatgctatggttacatttattttgttgaaaatatttttttcagatgatattgttcttttttctaaataagcttcttttttaaacaacagttttaagttcacagcaaaactgaaaggaaagtacagcattatcccatatacccttatccccacatgcatagcctcccccattatcaacatccattactagagtggtatatttgctacaattgatgaacctatgttgatgcatccttatcacccagcatgcaaagtgtatgtgagcatgtactcttggtggtgtacttcttaaggatctggacaaatgtgtggtcacatgtatcaatattatagcatcataaagagtagtttcattgtcctaaaaagtctctgttctgcctattcagccctccctcctactaacctctggcgaccacggatcttgttactatctccttagctttgccttttccagaatgtcatacagttagttggagtctgatatggtttgactgtgtccccacccaaatctcatcttgaattcccacatgttgtgggagggacccagtgggaggtgattgaatcatggaagcaggtctttcccatgctgttctcatgatagtaaataagtctcatgagatctgatggttttaaaaatgggagtttccctgcccaagctttttctttgcctgctgccatccctgtaagccttgatttgctcctccttgccttccaccatgattgtgaggcctccctagccacgtggaactataagtccattaaaccctttttcctgtataaattacccagtcttgggtatgtctttatcagcaatgtgaaaatgaactaatacagtaaattggtaccagtagagtggggcactgctgaaaagatacctaaaaacgtggaagcaactttggaactgggtaacaggaagaggttggaacagtttggagggctcagaagaagacaggaaaatgtcagaaaatttggaacttcctagagacttgttgaatggctttgactaaaatgctgataagtatatggacaattaaatccaggctgaagtggtctcaaatggagatgaggaacttgttgggaactggactgaaacaaaggtaactcttgttacattttagcaaagagactggtggcattttgcccctgtcctagaaatttgtggaactttgaacttgagggagatgatttagggcatctggcagaagaaatttctaagcagcaaagcattcaagaggtgacttgggtgctgttaaaaacattccatttttaaaagggaaacagcacaacagtttggaaaatttgcagcctgacaatgctgaaaattgtcagaaaatcccattttctgaggagaaattgaagccctgcagaaatttgcataagtaacaaggagctgaatgttaatacccaagacaatgggaaaatgtctccagggcttgtcagaggtcttcacagcagccccacccatcacaggcccagtaccctaggaggaggagatggtttcgtgggccaggcccaggacaccgccccctccccgtgtagcctagggacatggtaccctgtgttccagctgctccagcatggctaaaagggatcaatgtacagcttgggcagttgcttcagagagtggaagccgcaagccttggcagcttccatgtggtgttgagcctgcgggtgcacggaactcaagaattgaggtttgggaacctccgcctagatttcagaggatgtatggaaacacctggatgcccaggcaaaagtttgctgcaggggtggagaacctgtgctagtgtagtgtgaaaggacaatgtggggtcagagcccccacagagagtccttactggggcatcacctagtggagctgtgagaagagcaccaccatcctccagaccccagaatggtagatccacctacagcttgcaccatgtgccttgaaaaaccacagacactcaacgccagccagtgcaagcagagaggaggggggctataccccgcaaagtcacagggtggagctacccaagaccatgggaacccacctcttgcatcagcgtgacctggtagatgtgagacatggagtcaaaggagatcattttggagctttaagatttcactgccctgctggggacttccatggggcctttagcaccttggttttggccaatttctccttttgaatggctgtatttacccattgcctgtaccccctctgtatctaggaagtaactaacttgcttttgattttacaggctcataggcagaagggacttgtcttgtctcacatgagacgttggtctatggacttttgagttaatgctgaaatgagttaagactttgagggactgttgggaaggcatgattagttttgaaatgtgaggacatgagatttgggaggggccagaggtgaaatgatgtggtttggctctgtgtccctacccaaatctcaacttgaattaccacatgttgtgggagggacctggtgggaggtaattgaatcatgggtgcaggtctttccctgtgggagcatggtttcccatgctgttctggtgatagtaaataagtctcacaagacccaatgtttttaaaaaggggagttgccctgcagaagctctctttttgcctgccaccattcatgtaagacttgcttctccttgccttgcaccatggttatgaggcctcaccagccatgtggaactctaagttcattaaaagctttttcctatataaattacccagtcttgggtatgtctttttttgttttatggagtctcactctgttgctcaggttggagtgcagtggtgcaatctcagcaccaaaacctccacctcctgggttcaagggattctcctgcctcagcttcccgtgtagcttgtggcaccatgcttggctaatttttgtatttttagtagagacagggtttcactatgttggccaggctggtctcaaactcctgaccttgtgatctgccttcctcagccacccaaaatgctgggattataggcgtgagccaccacacctggcaggtatgtctttatctgcattgtgaaaatggactaatgcaaacacacatagtatgttaagttttttcagttggcttatttcacttagtaatatgcatttatggtttatccatgtctttttatgccttgatttattgctcatttctttttatcactgagcagtattctattttctgaatatgacagtttatttatccatccacatactgaagggcatcttgtttgcttccatgttttggcaattatgaatgcagctgctacaaacattcatgtgcaaaattttgtgtggacatagttttcaactcatttgggtaaatactaaagaatacaattgtggaagcatgggtagctttgtaagaaaccatcaaactgtctttcaacatagctgtataagtttgcatccctaccagcaatgaatgagagttcctcatgctccacatcctcaccagcatttgatgttgtcagtcttctggatttaagcaattttgttaggtatgccatgatatttcattgttactttaatttgcaatcccctaatgccatatgatatagaacatcttttcatatgcttatttgttatctgtgtatcttaattgggttgttaactttttatcattgagttttaatagttctttatatattttgtgtaacggtcttttgtcagattgccttatttattcatttattttaatcaatttatttgttttgatttcaataggttttgggggaacaggtggtatttggtcacatatataagttcttcagtggtgatatctaagattttggtgcacccatcacccaaacagtgtacactgaacacaatgtgtagtcttttatctctcacctccaattattgattgatgggcatttgggcaggttccatatttttgcaattgtgaattgtgatgttataaacatgcatatgcaagtatctttttcgtataatgacttcttttcctctgggtacatatccagcagtgggattgctggatcaaatggtagttctacttttagttctttaagggatcttcatactgttttctagtggttgtactaatttacattcccaccagcagtgtagaagtgttcccttttcaccatatccatgccaacatctactattttttgatttttttattatggccatttttgcaggagtaaggtggcatcacaaaaccacaatgtggttttgatttgtatttctctgatcattagtgattttttaaaatatgtttgatgtccatttgcatatcttcttttgagaattgtctattcttgtccttagcccactttttgatgagattgcttttttcttgctgacttgagttcctcgtagattctggatattattcctttgtcagatgtatagattgtgaagattttctcccactctacaggttgtctgtttactgattgttactttttctgtgccttttagttcaattaagttgcatctatttatctttgttttgttgcatttactttgggttcttggtcatgaagtctgcctaagccaatgtctagaagggttattccaatgttatcttctagaatttttatggtttcaggtcttagatataaatgcttgagccatcttgagtcgatttttgtaaagtaagagatgaggatccagtttcattcttctacatgtggtttgccaattatcccagcaccatttgttgaatagggggtccttttcccacttcatttttgtttgctttgtcaaagatcagttggatgtaagtatttggctttatttctgggttctacattctgtccattggtctatatgcctatctttataccagtaacatgctgttttggtgactatggccttatagtatagtttgaagtcaggtaatgtgatgtcttcagatttgttctttttgcttagtcttgctttggctatgaaaggctccttttgggttccacatgaattttaggattgttttttctagttctgtgaagaacgatggttgtattttttgggaattgcattgaatttgcagattgcttttagcggtatggtcattttcacaatattgattctacccatctgtattagtccattctcatgctgctaagaaagacatacctgagactgggtaatttagaaaggaaagaggtttaatggattcacagtttcacatggctggcaaggcctctcaatcatggtggtaggtgaaggaagagcaaaggcatgtcttacatggcagcagataaaagagtgtgtgcaagggaactgcccttataaaaccatcatttctcatgagacttactcactaacacaagaacagcatgggagaaacctgcccctgtgattcagttacctcccactgggtgtctcccaggacacatggggattatgggcactataattcaagataagttttgggtgggggcacatccaaatcatatcaccatccatcagcatggaatgtgtttccatttgtttgtgtcacctataatttttttcagcaatgttttgtagttttctttgcacagttctttcacctccttggttaggtatattcctaagtttatttatttatttgaagctattgtaaaaagggttgagttcttgatttgattctcagcttagtcactgtttgtgtatagcagacctactgatttgtgtacattaattttgcatcctgaagctttgctgaattcatttaccagttgcaggagctttttggataagtctttagcattttctaggtatacaattatatcatcagcaaacagtgacagtttgacttcctctttgccaatttggatgccctttaattctttctcttatctgattgccctggctatgacttccagtactatgttgaatagaagtggtaagactggacatccttgtcttgttacacttttcaagggaaatgctttcaacttctccttgttaagtattgtgttggctgtgggtttgtcatagatggtgatatggtttggctgtgtccccactcagatctcatcttgaatttccaagtgttgtgggagggacatgatgggaggtaattgaatcatgggggcaggtcttttacatgctggtctcatgatagtgaataagtctcacaagatctaatggctttataaggtggagtttccctgcacaagctctctctttgactgctgccatccacgtaagatgtgacttgctcctccttgccttctgccatgattgtgaggcctccccagtcatgcaaaactgtaagttcattaaattctttttccagtataaattacccagtctcaggtatgtctttatcagcagtgtgaaaacaaacaaatacagatggcttttattgcattaagttatgtcccttctacgctgattttgctgagggttttaattataaaaggatagtgaattttgtgaaatgctttttctgcatctatggagatgatcatgtgatttttgtttttaattctgtttttgtggtgtattacatttactaacttgtggatgttaaactatccctgcatccctggtatggaacccacttgatcatggtggattatctttttgatacactgttggattcagttagctagtgttttgttatggatatttgcacctatgttcatcagagatattggtctgtggttttcttttttttgttatgtcatttcctggttttggtattagggtgatactggcttcatagaatgacttagggaggattctctctttctctatcttatggcatagtgtcagtaggattggtaccaatttttctttgaatgtctgatagaattcagctgtgaatccatctggtcctggactctattttgttgacaattgtttgattaccatttcagtcttgctgcctgttattcgttcattcagagtttctatttcttcctgctttaatctagaaggcttgtatctttccaggaatttatccatctcctctaggttttctagtttatgcgcatagaaatgttcatggtagccttgaattatctttcatatttctctgttgtcagttttgatatcttccattccatttctaattgaacttatttggattttctgtcttcttttcttggttaatcttgctagtggtctatcaattttatttatcttttcaaataaccaggttttgtctcatttatcttttgtattttttttgtttcaatttcatttagttctgtttggatcttggttatttcctttcttctgctgggtttgggtttggtttgttcttgtttctctagttccttgaggtgtgaccttatattgtctgtttgtgctctttcagactttttgatgtaagcatttagggctatgaactttcctcttggcaccgcctttgctgtatcccagaggttttgataggttttggcactattatcattcaattcaatgaatttttaaatttccatcttgatttcattgttgacccaaaaatcatttgggagcaggttatttaattccaatgtatttgcgtggttctgagggttccttttcgagttgatttccagttttattccactgtgatctgagagagtgcttgatataatttcaattttcttaaatttattgaaacttgttttgtggcctgtcatatggtctatcttggagaatgttccatgtgctgataaatagaatgtatattctgtagttcttgggtagaatgttctgtaaatatctgttaagttcatttgttctagggtgtagtttaaatccattgtttctttgttcattttccatcttgatgacctgtctagtgctgtcagtggagtattgaaatcccccactattattgtgttgctgtctatctcatttcttaggtctagaagtaactgttttataaatttaggagctccagtgtcagatgcatatattcttgggattgtgatatttttctgttggacaagtcattttatcattatatgatgcctctctgtgtattttttaactgctgttgctttaatgtttgttttgtctgatgtaagagtagctgttcctgcttgcttttggtgttcatttgtttggaatatctttttccacccctttaccttaagtttagaagagtccttatgtgtcaggtgagtctcttgaagacagcagatacttggttagtgaattcttatccattctgccactctttaccttttatgtggaacatttaggccatttatagtcaatgttagtattgtgatatgaggtactattctattattcctgttatttgttgtctgaaaatttggtgttttttaaattgaggttttgttttataggtcctatgagatttgtactttaaggaggttctattttggtgtgttttgaggatttgtttcaagatttggagctacctctagcagttcttatagtgctagcttggtagtacaaattctctcagcatttctttgtctgaaaaagactatatctttccttcatttatgaagcttagtttcccaggatgcaaaattcttggctgatagttgttttgtttaaggagactgaaaatagggcccaaatcccttctagcttgtaaggattctgttgagaaatctgttgttaatctgataggttttcctttataggttacctggtgcttttgcctcatggcttttaagattctttcctttcatcttgactttagataccctgatgactatgtgcctagacaatgatctttttgcaataaatttctcaggtcttcttttaaactggcctttttaaatgaattgtgctagtcttcagtgagcagtttgaatatggagtctctaattcatttttaagttcttgaaagttttcttgaattatttacttgataattttctcctatgtattttttttttcagttctgtttctgtaactactgttagttttgtattacataggaatttattctctagatttcatttttacaaacattcatctcattgtccttttattccactttctgggagatttacttaaatatatcttccaattatttgactttttaatactcatctgttaatttttttattttcaacactacttttgcattttcagattgtttctttttcataacaacctgttcttattttatggctacaatatcttttattatttacatctatcattattttctgttttctgcatatattatgcatgcattttttttctatttccttgttttctgtttcttttgacatttgactttcattttggaagtttccctcaatttatgatcatcttctgctgctgattcatatttaagaataaagcaaaaaataaagacagattttgaaatgtgtttgagtggaaggttttatgttcactgtagcttggtcttgctgagccagcccttttggaggatacctgatttagtgtatataggtttttctctagagagacattgaattttttcagaaaacacctcatactcttgcttgggaacataacccttgcttccaggaggctgaggatctcaccattctgtgtatggatttggggctttcagctacaagttgaaaaccaattctccattgtgtccgttgctctctttatttcaagtactgagggaaaaaattttttgccttctctctgggagaggactacagttgcatgcctattctctaggtattgactttcaaccagtactctgttcctcttttaccccagcattttgttgtgctttttaagatatcctggactcttagtctgacttactacctctataaatgaaaattgcttgaattttcagagcctctttacccttatctgtagaatgtccaccttaggaattgaaagaattatttatgtaaaaatactttatggctggatgtggtggttcacacctataatccaagcactttgggaggctgaggcaggcagatcacttgaggtcaggagtttgagaccagcctggccaacatggcaaagcccgactctaccaaaaatacagaagttattctgcacctgtagtcccagctactccagaggctgaggcaggagaattgcttgaacccacgaggttgtggttgcagtgagtcaagatcatgacactgcactccagactgggcgacagagtgaaactctgtcccaaaaagaaaaacaaaaacaaaaacaaaaactttgtgaagtaactgtaaaccacagtacaattcagctatatgactgtgacttctttctatgccattagatgagaaactcatatatgacagctacactgctacagatttatatggtctcttttttcgtttttcttttctttctttcttatttatttatttttttgagtcggagtctcattctgttgcccaagttggagtgcagtggtgcaatctcggctcattgtggcctccgcctcctgggttcaagcaattctgcctcagtgtcctgagtagctaggataagaagcatgtttcaccacatctggctaatagatatttcttttaagttttatataatcttaaaagttcaggcaaatcaataaatgtaatccagcatatatacagaaccaaagaaaaaaaccacatgattatctcaatagatgcagaaaaggcctttgacaaaatttaacaacccttcatgctaaaaactctcaataaattaggtattgatgagacgtatctcaaaataataagagctatctgtgacaaacccacagccaatatcatactgaatgggcaaaaactggaagcattccctttgaaaactggcacaagacagggatgccctctctcaccactcctattcaacatagtgttggatgttctggccagggcaattaggcaggagaaggaaataaagagtattcaattaggaaaagaggaagtcaaattgtccctgtttgcagacaacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatccaacttacaagggatgtgaaggacctcttcaaggagaactacaaaccactgctcaaggaaataaaagaggatacaaacaaatggaagaacattccatgctcatggataggaagaatcaatatcgtgaaaatggccatactgcccaaggtaatttacagattcaatgccatccccatcaagctaccaatgactttcttcacggaactggaaaaaactactttaaaattcatatggaaccaaaaaggagcccgcatcgccaagtcaatcctaagccaaaagaacaaagctggaggcatcacactacctgacttcaaactatactacaaggctatactatactacaagtaaccaactatactacaagtaaccaaaacagcatggtactggtaccaaaacagagatatagatcaatggaacacaacagagccctcagaaataatgccgcatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagctggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaaaaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagatatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatcgtggaagtcagtgtggcgattcctcagggatctagaactagaaataccatttgacccagccatcccattactgggtatatacccaaaggactataaatcatgctgctgtaaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaatcatcattctcagtaaactattgcaagaacaaaaaaccaaacaccacatattctcactcataggtgggaattgaacaatgagaacacatggacacaggaaggggaacatcacactctggggactgttgtggggtggggggagggggagggatagcattgggagatatacctaatgccagatgatgagttagtgagtgcagcgcaccaacacggcacatgtgtacatatgtaactaacctgcacattgtgcacatgtaccctaaaacttaaagtataacaataataaatttaaaaaaaaaagaaaaaaggaaaaataatcttgtaaaaaaaaaagttcacatgaatcttgcatcttgctccataatttatctgttttaatgtaaaaataatgttcttcaatcttttatcatggagccaaactgacaattcaggaagatatgtgtattccttttgggatttatgtgcctcccagcatattgggagatatccttagcagtttatgtacccctgtttaagttttatagaaataatctctaagccattagttctgataaatttggttccttccaatcctttgtttctaaactttgattcaggatgatctgacaaattaaatagcacccttaaacaataaggcatcatggcccagtatacagagaaatatggagatagaatagaattggcatggtgtctcacgcctgtaatcccagcactttgggaggccaaggcaggcggatcatgaggtcaggagatcaagaccatcctggctaacacagtgaaaccccatctctactaaaaatacaaaaaattagccacgcgtggtggcgggcacctgtagtcccagctactcgggaggctgaggtaggagaatggcatgaatccaggaggcagagcttgcagtgagtggagattgctccactgcactccagcctgggcgacagagcaagactccatctcaaaaaaaaaaaaaaagaatagaattgactatgggctgttgagggagtagcttattacaaatgtgtaaacctacttgtgccttgttgttgtacagaacagtgaaaattgccaggggagtggagaagaaaattagcagtgtctgcctattctggatatttcacatcaatggaatcatacaataagtggactttgagtctagattctttcacttagcatgcatgatttttcaaagtttgtgttttagcaaatatcagtacttcattcatttttatgactgaataatattccattgtatggatataactcattttgtttattcaatcatcagttgatagatgtttgatgatttctcttttggctactgtgagtagcgttgttatgcatattcttgtacaggtgtttacttgaatacctgttttcagttcttttgggaatacttaggagtagaattgatggatacagtaagtctatgtttaatttattgaagatctgtcaaattgctttctacagtgattgaatcattttatattcctactagcaacgttgaaggttcaaatttcttcacattcttgccaacccttgttatttttcatttttttaaatagccatactaatcagtgagaggtagaatctcattgtggtttttgttttcattttcctaatgactaatgacattgagcattttttcaagcgcttgttgaccatttatatatctttagagatatgtcaagtcttttgcccatttttaaattgggtcgtttgtctttgtgccgtggtgtttcaagcataaatctatagacaaaataaaagctacttgttggctgttttattggaaatcacacaacttgggaaagtctcaaggataaattttgctaaattctttgtccactattcactaagagggtcccttaccctttcttttcctttgatcattggttatctggtttcacctgtcaagaaataagctgccctttgattgtggataataggtgagacaccgcagaatcaagttacactgttgcatctgtaaagtttcatcactgtgtgtttccaggagtcaggatttgccatcaaagtcaattgccgaatgactctgactttattattctttatttgcattaacaattgctctaagcagtaacacgattataacccaaaacagcagcctgttatctatcatttatttgatttaatacatagaaatggatgtctttcaaagagcatttatttttttcttcacattctcttccaaaatcattctcagtggaaacatttagccttataacatggaggaattcctttgtaaatccagtgactatgtgggagactaagaatttctgattttattaagtattttggataaatgggtaaagagaggaatggtggcagattttacaatggttggtttaggcttctgtaggccttgagtaaggtgagtaggagtaatgcctgtggtcatttcatttgaatggcctatttattgaagtaaattcatagttcaaaaagatccaacttagaaaagcctgaggcagaaatggaatcctgggagtgcagattggtcattgttttatttaatctgattccactttattctcctcacggtgaaattgttctttatgatactctgtatctactggtagttcacatccttcacagaatcctctaactatgcaaaacacatagtgaacagttatcatttgaatcttagtacaactttaataagctgtgttttatatttaagtagtttctcccctggtggttgcccgtggcagactttggagtttgatagctcttcactccctattttatacatctctaagtaattataccctgtgcccttaagcctcaaaagcataaaattatttaaaaacatacaattaaacacttcagatgacagtgttaaaacttcagaagaagacactcactttggaagaatggtgcttcgtgctggagcctttatatcagctccttcttctccagagactttgggctgaagtttctgtctcagcatgggcatctgccatgcttgttacaggctcaggatgacccagcctcaaaattctattaacttgggataccattttgcaagggaattcttgtcatcagctttgagggaggggaagcataatgatatacctgatgttgacagtaagtgttgtagtggcagtgaccacgtgttatactcctgatggtatgctaggctccctaggtacattgttttacttaatcctattgaaaccccacaaggtgattgttattaccctctcattttacagatggaaagactggggcttaagtagttgtttggttagtgagacagtaaaaagcagaataaggatccagacttaggtaaactgaccacagttctgaaaaagcaagctgggcagggtcttgatggtgcatagcatgtcttcagcatggtctcctctgggcagtgtgtctgactttcctagtcagcctgaccacatggcctcctgtttccttggcaccctgtacgtgcttcttctgcagctgttgtcatcgatatggcaactccctccaaacctgtccccatccccccagcctgtaaacttcttgagagcaatgatgctgtgttgtttacctctgtatcttcaagactcaacacagaacaggagttcaaagtttgtggaatgaatagtggaattaatggtaaaaaaaaaaaatgtgtacatacgtgaattaataggttgtttcctgctctctcccccaactcttaatataaaatgggcccagccattttcataagtccctgggtaaatcattccattatttttccctttactttgttcagtccccataattccttttttagactgccttgtgcattcttattttctacagttggcacttatctgtgatccaagccacatacagccttttaaaagtgtgagatcttacccattagtaggtcttgaaattaattttgagggtggcagccagcattttttttttaaatgaagagactagaaaagaatacaacttctcagcatgcatggcacatagaaagacacagtatttgtttcagatggatagataaatagaggacatatatgtatcactagcacttgtttgaccacaagtcacacactaggacatcatttaagacagtgaaagacatttaggcacatagacacagtatttgtttaagatggatagatagagaacatgtaagtatcactagcactgattaaatatcatacgtgcagccatgttttaagaaggccaaatgctgcagggatgctcattaggggagtgtattgcaacaaccactatccacattttaaaaaattgtacattgtgaccaattacatatctgctgtgtaccagattgtactctgaagtatattccttattgttggaaaaacactgtcctaaatgacgtcccagtgtgtgacttgtggtcaaacaccccttgctctgctaaagtagttcctaaagtcttatattttgtaaaagctattataaaactgtcaccaaagtttagaaaatttaatcccagtgcaattattttaatgatgttaaagtataaatgctgcagagaatttaataggaaaaacacatagaaagttctaaaaattttaatagtgggagcttaactttgaggtttgcagaattattttattttgtactcgtctttaaatttgcttctccaaatgttcacctaaaagtcccgctgctttaggtaaattgcgggggctacatttatatcagtcagtggcattcatgtaggatttcaacttcaacttgctgtgaaggagccagactttgctgtggaatgcattcatgtgcagagctgccttgcacagctcattggagataagacagttttgacttcacatgccaaacttttgtcactttgtctattttcgtatttctctatgactctgcagagccaagcttttgatcggttgagcagcaaattgaaaatgctcttcttaaaaaatctaatactaaagtgaataccaagcaatactgcatttcctgaaatgaatatttgttgagtgcttactctgagctagccaattgttgtaccctggggttataaaaaatgaatgagattcactttctgctctgaagagtcttctggtcgaggagctttcctaccgcagggtttggattcatcttgcttgggtctacgggtagactgaagatccttcgtttgccctcccaactcattctgggcctttccccacctttgacctgtgaggctggtcaatatgggctgcaatcgagggctcccttgctgtctggcatctggttaggtttaaccagggggagcactagcaggaactagagggaaggagaatggagaggttagcatatgtgttctcccggctccctccttgcaaggtcacccaggttggctctgtctctctactaaaagtcacagcttcattcaggtgtcctctccacactgttctttctgtttccatgttctagtgactgctccctcccctagcttgccctcctttcccctatagggtactgtgccatcccttgtggttttgctataccctcaccacaaactcctaaatcacccttttgacactgacttagtacctcactgaacacgactttactctgaactttttcctttaggtcctttcagtgctcttgacttatgccttagctaattttctgccatgatttcaaaagacttacgtatttgtacgtttccaggaagccatcttattaatcaatatggaaagttatttaaaaccacaacctctggttcttacaaatatgtgttagctctatgaaattgatacttggaaagctcaataactatttataactgtgggtgatgttgatcatgacccatcaataggtcagagccttcattgttaattacctagttcactaggctttgttacaggctggatggaggtaggtatcccgggaggaatagtcttacagaatagtaggagaacttaccactttgctgacaagttgaccaccagtccccactttgtgagtcctattttaagtgttgccatctgttctcagaaaagaattaaaaaggatgagataatcatttaagcccctggcaacagcaatagctgagtaagtggtcatttattcattgcctctgtatatcaggcattctacttcacaagcatcctactagaatctttaaattatcattatatttaacaattacaattaccctacgaggtcattcttaattccactttatagacagagaagctgggagtaaaagaatgtaggtgactttcccagggaagcacagctggttatttccagagctatgatttgaacccagctccatcaaactcagaagtattcctcccactatttcatctccccaaatctctttctttttgccttcaatgttgccaaaagtcatgtttggcatcaggtttaagattattaaaacttcaaactttcttttttcaaaatcaggcgttctataaattaaaaacaaaatctgattgggattcatctccttctcttccaatagaaacagagtagagggcatggaatttgagggaaaaggaggaagaataaatgaacagcatatgagcaaaggacctggggaacccccaagtgactaacaatcaaaaatagaattttctgcatgtcagatattgagtcattcgctgcatggcccaattaacctttcttctgattccagattttgaacttgtgtccttggagaacaaaatgcttacccattgccttggctgagtcacttctgtgcagttttagatgaaccctgcttgcacattattccattggaaacaagcattttcacagtaggttaaggactgggactaaaagaaaagagaaagctaagatgtccatctgaaaactgtcagtgtcgtctcaatggaaagttatgatgttttacttctctgaaaaagctaaagaaagcaatctggccagttataaatttaatttatgaaaataataccacaggcctaaatcatccaacactatagctattgattcttctttctagttccttggggaacagttgctgtatttgagaaggtagaactacaattgtcttactttgtcatttaaatgtcatattagccaaacactgagcacagctgaagggttgcaaactgactaggaaagaatgggatagtatttttcattttttttttaaatgtaattggtagacagattttcctgttggtgagggctgattttttttcctcattatttctctctccttttattttctccacaatgttgcattttcttggttttctgtgaggcattaggaaaggataaatcatgacgttctgggtctatggtcttttttaatctctcagattattttctttaacagaattgttggaaagttggctgttacctgacagaaaataaaacaaccaatttttcatcgcaagttaaataaacattgaaaaatcagcattctacaaggaccattagcttatgtatcactgtaaaatgttttatgactcttggtataaaggatgctcatataaaaataaattgtgtcataacaaacatttctcccagtcatggtttgtaatagccttaatctcaaataaatctaggttgaacattgtagtctccagaaaaactgaccttcagtttcaaatagttgggttaaatcattgtgatgatgacatagtctcagatataaggagatatgaacttgtatcagctccccagataatcttttatttagaagaggagagatgtctcaatgaactgaaattgctcttgagtgaaccattttatttatatatcttcttattctgactaccagttcacacacagtgccacagagaatcctgcacatagctccctagggttcctgagagagcaatccatggaaatacatagattaaaaaccatgagcaattgccattttacatctgtcaaattagaaagcatttttaaagtgcaatactgctgctacaatgttggtgaagtgactggactcatatactactggtagcaatataattgctttggaaagtattttggcaatacatcaagtgttaatatactttgatactacaattacacttctgagaattttgtgtaaggagtaatttagaagaattcagaaggctaagatgttcactgcagaattttttatactagtgaacagttagaaacaactacgtgctcaacaatggagactcttagtcaattttaaaagtctgtaatgggttatttgcatgaagtctaattggcaacgtttaaaattttgtgatatagagctcagtaaaaagtactaattataagcatataaaattattgcatatagataagaagcagacttcgctaaaattgttcagatttagctgttaaatgatattttagctttataatttttgtattaaacaataagatctaaaaactacttgactgtgaagattaatattaatgaaaagatgtttttattcgcactttccttaagatgttttagttgttcaagtatgaatctttgagacctgaaagtgtcaaggattcggagaattggcatttatatgatctaatttacaaaaaaagaaaagaaaccaaataaatgaacaaaagagagagacattcttccagaataatgaaacctcccattcttgttcttttggggatttttaatgttggcacttggagtaagaagatctcatcagataatttagagagaagtcattcctttaacatgatgaagcagtgtagcttgtggccatgaaccgtgaaatgtcctgatatgagtggcgtaagtaggctttttggaaggggctctatcccaaagagccataggacagaagaaaatgtgaatataggtgatccatccctgctatgcttgaatcagatctataaacattgcatagggaaaaaagaaaacttttggaaataacctaaatgcccaacaactggggattagttaaataaagcatggtatagtcagatgatgaattattaagtaggcattgagagtaaagtagaaaaatattaatattaatattaatctgattaagtgtctgcagtaaagttatgtgaaaaagggagataaaaattatgtatacaatattaaaaagttgtaaacttatcaatagtggttatctggatgttggaataatagacaattaattctctattcctgtccatattcttcaattttttttctcctatactgtgcattactaaaataattaggaaaaattttttgcaattattttttcttaaactgtatgggtacccaaatacataatgaatgagctattgcctgaaataatttaaaaagtggcagcatataaattgcaataaaatgaaatacaattttcactgtataaatggaatgaaagtctaaagcagtactcaggtaaggacatttcgttttaatgtaacgccagtgaggagcttgcatttaagtgccaaatattggtatttatgtatatgaaagctcttctttactctcttatattttctttttttctaaaattttttttttgctaaaattagggtgtcatatataccagaatcaatcaattcttccttctctccttcttttctttctttcttccatccccctacctttcaattctgcaaagataggcaagtgagtgagggtgggtctagcttagtgtttgcccatatgtaaaatgttttgagttcataaaatcctgaaaaaattaaagcagcagacagaaaacagaaaagacccccacttagatactgattagcaaatagacacaaacatttcctctaaatacttcagtgcctgtgatttaagtagctacttgggacacattgaagagtctgttgttagctttctgcattcacatgataagaaacaaagaattctttaggcttgacctttgcaaatagaaaatcctgaaaacgagaatgctgtaatttttctttgtgaagctcaaacatatattgaaagagattggcctcgaatctgtcaccttctcatcactaaatatggcagccctgaagttaattaaataatgcaaatgctcaaggcggccttcactcactcctttcgatgcactgataaatggaggattttagttaggggtttgttcttgttcttactcatttttttaccaaaagattttgtctttgcttgtaatacttgaggatctacactcccattatctcaattgaggctaagggactaagggattccctgtccagtgtgtgatgggccagtgtaatcattataagtgatttcaaatcaatataatttggcaatagcaaaaactatgagaatttctcctcaactttttattggttttaggtaaatacttatgaagtagaggaaagaaggtaggacatgtgaatggaaggaaggagggaaagagaaaaatactctgaagtcatgcaggaaaaaataatttctttccttggccactgaacctgttgatgtggactcatttgttttttctcccttggtggtttaaaagagaaagcctcaccaaagggtaatcaattgattattataatattattagctggattaaaataatgttatttgtgcagaaaacaattcttgcatatgtttattttaaattcctctgattatgtgttgtaatggcttagcctaggagttagccaaaaatgatgtttttctaacacaagactgttgttgaaagacttctttttccctaattatttattgtgatcctaacacaacacacaccctcctgtttcctccttcatgccatcatcatttacatttttgttacctccttgtggatttgagggacgatatctaatagtacagaacatagcattgctccaggacctagcacaatgtcttgcctagtgtaggtgtttagtaaatattgaatgaattaaattcagaaccctgagggagaaaagtcacaaatttatcaagtaattcacaaagagacatatccctgacagctaatccagttaaaagtattaaggtaagctgaaaccagaatatgtttcaaatcatttctcttcttataagagttttgttactggctggaacagttgtttcttggtatgctgatcgaatgtgacttgagccagaaagattcacaatgaataacaccaggaggcttatgaatgatgtataaagccaaccagtctaatgacaggtaaggcagaggtgagcagttactttatttcagagcagccaaagtcttggcaatgtaatgcaaccacgggaatagtgagtggttgtgaccagtttgtagtaaacttctagaatgaaacaagctttaaatgttctgatggatatttgatcttttgtattaatggagccattgcttcagatgagcacaaatgaaaatggcccctcttgctcctctagtatttgcccaggggttacaaggatcagctaagtgctatggagggtattaatcactttttacttgcagtgaaactatatttgttttttggtaactagcaattctaatacagtaaaacttcaactactaaataaatatcattagtattatgactttaattgaagaccaaggtgtcaccatcttgaagaaaatggtgaaagtttactttctgttccctattgatacaccagggccaacactgatgacctgttaacaataatgatataatttttttttaatttttcctgaattttctttctaaaatctaggttcggcaacagaataatcaaaggatttattgctttgccattctgtgcctagcactgtgaatctctgtaactgacttgatagaaacatagatcataatatttttgggtggaaatgaatcacagcttatggttgcaaaagattccacatgaagctaatggattgtagacatctgggaatgggaaatgatatggtagactggctagctgaagactgggatctactcccactgcatgtgtttctgtatataaaaccaattgctcatgcttctgtttattcattaaatgaaactcttattttatcaggtgggttccttttcagtggcaagttaaaataaattagaagaactagaaagtgatgtcacaaacatgaaatacattttctcctgtgttgtctccctgttgaaaaaaccttttcaaacagatttttccctcatggttccccaaatccaataggggggaaaaatccagggtttcttttcccctggagtttggataaaaactcaaggcttgatctctttagtccaaatgaggtcacctgtccattccaagaggccatcactgaggccaagagaatacctgggtcacagttctctactggaagtgggattagctccacataaactgggttgagcacagggcgggaattcttatgctgaggtgattttaccagaagtagaaattggatgttgtaggcacatgacagatattcactgtgcttactggtagccaggtcctttacagattgttgatacaaagacaaacatgacttgatctctttccctctctgaatctcaccacctgatctttgttaataataccctgtggtcaatttttcttacgtcatatttctaatattgtcctacccttcttcaaaaatgtttctggttctttatcatctattgattaaaatattaactccttggttaactttcttcaatctacctctcaatcctggcaaaagtgactgattacatatccttggattttcctgcctctgtgagtgtcctggaatgtcttcctccatgctaatcactgaccatctgaataccgttaaggtgtagttcagatactgtcttcataaaacacccactgatttccttcatctactgtctatagcacttaacatgaacctatcttaaagcacttactgtttgtttaacaagtagtgccaaatgcttactatgttcttattgtttttctgagtgcttaaaaatatgtttttctactttgtatcagtgttcttggtgctcttgtcttttattcccagtaagcgataagctcagtgaagccgggattcttaaaggcaatgagttacctacccatagtgggcaaacaacatatttatactggataaatacatgttaatccaatttgcacatttattgagcactagcacttcaaacctaagagagtagggccctattttctttcaaatctctctctgcacatagtatggtgacatatatgtgttaggcattcaataaacatttgctaggcctctaaatgtgatggaaatttcaaatatccagatatctaagaatgagccatttccttttgttttacattcttcagtctttaggcatcatttttgaaacctcttgtcattttgctcttcctaacagtttttacaagaatgtctaagttctactttctaagttgagcaggatttgggtccccttttttttttttaacaacagggacattttcagcaattgcaaatgcctatgctattgagccattgctaaaatactgggttttataaagtgcttctaagggccaaagagctttgctggcccatggtctgtgcaggtgttcatgagttaaagcattcaatggccctagcaaacatgacatttaaggaggtaagcattgatttgtagagtcactttcaagtacaatagaacatcttgccttcatttgtgagtttcttgtttgaaatggccgacattttaggtgtttccatgtagaaattttgtctaaaatatgtaaagcataaatgggtaaaagaaaagattcatttacttgatctcatccatgctggacaaggacaaggcttccatgttgtctttctattctgaacaagagattggaagcctttctctctcttttttcttttctgttcttttcttttcagttttcctcttttgtcgtttctcttcatgaataacttttcaaccaagttagatgaatgccaatagctgtcaattgccactgacaactagaatggccttggtgatctgtgtgagaacaattttagggaagtggtgaaggcagaagccagatgacagtggatgaacagttgactcagtagtctggtgagtgagatgtgagctccggaaagggaccacccaagctaaaacccagactctgctactcactagctgctgacaataggcatgttaccaaagcgctcactctccctgcctcaatcttttcctctataaaatgggaataaaaatagaactatctcaaggttgttatgagtagtaaatgagttcacgtggataagatgcttagaacaatgccagtttcattataagtactcggtaaaaattagctgttgtttttggtgcacgtgcgaagacagcaagttgagactacttttgaagcttaattatgaaaattggagagaaaaacgaggccagaggtagatacaggccaggaattaggtgaaaggtgattattttatattctgggggaaaagaagtggctctcggagagtgacagattacaaatgggggaagaaggattaattgatggagtaatagtgctgaaaggcgagtgaggatggaattcagagaagaggtgaatagatggatggataaatcttggatagaaggggcttcttgttctctaaggctgaggctaaagtggaggtaataaggaggaaaggctaagaatgcatgtctttgtgggtggggagtagagagttgaaaggattgaaccctaacagcttactgtctctgtgaaatagaaacaagctcatctgatgggagacaagaggtttcagagtgaggaatagagtagaactcataaatgaaggagaagtcacacagcagtaactcctagagacccgatgacactagccagaatgtatagtctaaccaaaggattgagaagtcaggtatgataagaaattgtgctcacacagtgagacactggcatttgcttccacaggtgggacatttctaggtggtgacaaatctgagatgaaccatttgaaaatttttgtggtctgcagtgtacagcttgaacttaaaaaatatttttaccacaaataaatgattgattatattcatacctttcttgagttattaaattatcttctgtttcctatacatttgcagtgctattgggatggtagactttcagagttgaattatatcctgcctctattccacctaatgcatccttgagaatagttatagatgggaaagtcacattttattgtgcttatcatgttattctttagtagacattccattaatgtagaaacatacatggtgtgatacggattttatcttgtgatgatcagatgaaaagccctcctttcctgcatactcttttgcaatgttatttcatcactcttcccatcaagaggtggagtctacatttcctcctattgaatctgagccaggcttggaattagtttaaccaggataaggcaaaagtagcacagtgtgacttctgtgcctaaaccttaagatacattgcacttttcatttttgccatgttagaatcctgagctaacaagaaaaaaaaaagctttaatttccctggcctgccagagagaaaggccaggtagacagagacccaggggatgaaaaaccatagaaagagatagggtgagacagtgagacagcatcaacgagttcaatcaccccaacagagacattggacatgttagtaggaccagcttgcctcagtcaacacatgtggcacagagacaaaccattgccatagagcctccccacaatgcagaattgtgagcaaaaacatggggactgtcactttaagcagaatagttttgagagctttattatgctgcaatagggcatgaaaagaaagagcctcaaagcagagagacaaattacaagaccactggcataatccagatgtcaggcaatgagctggaaagtatagagagaaaggtagaggaaaatgtgggagagcagtaggtggcaaggttcagcgggacctcatgattggatctgggacaaaggagaaagagaaataaagattactatgacactctgtttctaggaaaataagattgtgaacagcaatatggtctagataaagaactggattttgggggaagataagtccaattggcagttgttatttcttgatgtgataccacaacttctatgtaaaacactcctaagcagctggagatacagaccagaagcaaaggatggagtcaggtgattagaatagctattaactgtttttgtttcaaacaaaaagatgcagtcagctctacttccctgttgttccagcctaaagggtgttttctaatttccttctaactcctatattgagtaggaaaggtagagatgtcaagagaaggcggaagagagaaagagaggagagggagaggactcttgtgaagagaaaaagccaactcgcatcctgtgggattgcaccttattttagttgcacctcttggaagcttcactgcttatgtaaaaataagaaaagcaacatacacgctcaactaaaattatcgtcattcaagagtcctccctttaaatagcaccaaatgaaaataagaaaccctaacctcagctttttaaatcacaatggaaggataagagatgctttccatttatgggatcttagaaccttcaaaatggtgctacttttgttccgtgtgtgcatagggaggaagctgggaatgctgaggtggcgaggtttcacctggcagtcaggattgctacttcccactcaccaagttgtgcaatatttgcaagaagagcaaaaaataaaagatagtgtctctttaaaagggagacagtgtagtttaaagaggctacagtgtagtgtagcggcttacgctctgtggtcagcaagaactgagtttaggtccttgtcccatcacttactaactgtgagaccctggatacaatatcaactcctaaaaacctcagtcacttcagctgtaaaatagggagaatgctgtatactggggttgttttgaagagtaaagcagaatatgtatgaaaagcacttagtctggtaagggcacaagttactaagtggtaactatagtcattggaattagtaatttgggactttcacatatttggcttatcattgagactattttccaggaatgtttacaataagaaacttgggccaactgcattttagtcaaggattaaaatgtaacaaatgtgtaatattatattatgtaacagcagatgattttaaaatttacaagtgtcattaagatttctctcctagggtacaaatgttgttgtttcacagaatttttaaaaattattttatttattttttattctacttttatctctgggatacatgtgcagaacttgcagacctgccacataggcatacacgtggcatggtggtttgctgcacccatcaacccatcatctacattaggtatttctcctaatgctgtccctcccttagcccccagcccccgacaggccccgctgtgtgatgttcccctcactgtgtccttctgttctcattgttcaactcccacttataggtgagaacatgcggtgtttggttttctgttcttgtgttagtttgctgagaatgacgatttccagcttcatccatgtccctgcaaaggaaatgaactcatccttttttatggctgcatagtatttcatggtgtatatgtgccacattttccttatccagtctatcattgatgggcatttgggtcggaatttttataaaacttcaagcaaaccgaaactgacatactggctacttattttttttcttcataattctggatgtcagaaaatgaacaatgttctaatgcagaaggcaaactttctatgaaggaccagacagtaaatattttagctttgcaggccacatacgatctctatcacatacttctttgttatttcttacaacccttttaaatgtgtaaaaactattcctagctcatacaaaaacaggctattggtgggatttgcctcatagactgtagtttgctgacccctgctctagtataaatttgtcttgtttattactagagtgcttatgccagtaagtattttttaaaagagagagaaaatgcattaagtaaataacatttaagtgattctttttctgattcagacattttctgggatgaaatgagaccattgatcattttatttgatggaatagaactgtttttcattgcagtgcaatgaggttaggtatgattttgaggactggggaccattcagcacattagttctgaaccatatccttgtgctttgcagaatttttttctcttcctcagaggagcagtttgaatacagggctttatggcatcaggcataagctgccattaaaaccttcaactgaaaattgtgctgccctttatgaaaatgagcagctggtcagccggaccatcgcccaccctcagctctactcatgttgtgtacaagtagcttgaatagcccttcatgagcaggtcttctacagacattttcctatcagtgttgggagggaaagccagaccagcagctagtgtttctttcagcctgtgttgtgccttggcatctgactctctgtggacccaggagtgaaatatcttcctggaagtggtgatccaggttagtcttgtctctctgactcatgtcccaagttgcttccatagagatacctgtggcatcttttccccctttactctgttttcctgaatttccctctatttttcactgactacaaagataaagaaaaagaagaaacaattttaaaacatataaagtactttgaaatatttatccttggataactggagactagatcacattcttatcttttcatccagcatttttttttttggtgaataccatattatgtgtttaaaaagacatatggagacctgactcacactctgaatcttccaattttccattgaccacattcttaatgccctgagaacacaaggtcaggcaaaggagcctctcagctgaggtcctggccccaggccctaaacaggtcttctgtgagccaggccacagagttccttttggttggggtcagtcttagcagaatgtagatcctggagcaaatttggtcaagcagcttcctttgctcccatcaccctaagcctgcactggggcctgacttctggcatctcaccaatccagtcatgagggatggctggctcagaaagagcaccttgtcaaggaagaagcagctcaagatcacgaaagcccaagcacatttgtccctgtgcccagaacagagctagactggtctgcctctccctgcattcttggggctcttcactctgtgtattctcagggcaagggttgtaccaagggagagcacactgtccagcctcctctcaccaattcattcagtcatttacccactcaatacagatttagtgagtatctgtcatatgccagacacagttctaagtactgaagacacagaagtctttgctcattttactccataacttgctctgaagaggtgcctccaaggatcttactctttcatgggctctgttctcgatcacttttgctcagtattgtgaaacctatgggcctgtgatcagaaaaaaaatgtctttaaaccagtctaatccatgtcaaggtcctctttggaaggggagtagcaaggactggtgagaagggagctgtgagtgcttcttgaatgtaggacctgctccttactggggagaatagctcactcatttctaccttcctccaggtctcatgaacatgcacagtcctgtgtgttgcatctcctaatctcatctgattctctgctgtttgcctggtcttggactaatttccctttagcccacatgatgatctttaagttaagtctcagcctatttagactcaggctgcctcactcaccttgcagttgccatctttattatattatggcagtcaaaggttattttgtttggacagagaagttactctactgtatggtggactacctgtcctgaacgttcgcaaacatatccttttgttttctggagttcctcctggtttgttttctgatggatttctgttgactcccagattgaaccaatgtttatcctgtgtttggtgtatcaggcttttctgttctggttgatttcctgtagctaatttctagggagacttcaattcctcactgaagtcaagttccttgtcatagaggcccagtatttctaactcccattcagacagaaaatttgtttttattacccacaagagaaaatgatctggctttcctgctctaaagatacccctagtactactattttttccagtcttgtgttttcagatatttttctttaattgaccttctctatggtcagattcgtgactgtattccttcccctagtttattaattcttttttttttttttttttttgagatgaagtctcactctgtctcccaggctggagtgcagtggctcgatcttggctcactgtaagctctgcctcctgggttcatgccattctcctgcctcagcctcctgagtagctgggaccacaggtgcccgccaccacgcccggctaatttttttgtatttttagtagagacggggtttcactgtgttagacaggatggtctcgatctcctgaccttgtgatctgcccaccttggcctcccaaagtgctgggattacaggcgtaacccaccatgctctgccttattaatttctaagagtcttcctagaacactgtaagtatgcttaacctggtattatagagacatgtaacagaactaaatactttccactccacaaaagaagaggctattttgaactacatgtatcttcacagaggttactccagtaagtaacttgtggaagggagggtcattggaatatggaaacagacaaaataaaatctgttcccttttcctcaaacctcacatagcctcatacaattaaatgagatcttggttacctctcagcctgtaaagattcccctgagtgtgtatgtgtcaactcctgtcttggttcattttatgctgctataacagaatactgactgggtaatttataatgatcaggctgcgtgacttatgatgaacagaaatatatttgggttatggttctggaggctgagaagtccaagagcatgctggtggtatcttgtgagggccttcttgccatgtcataacatggcggaagccatcaaacggagtagagagaacatgcgcaagggtgggatagaagggggccaaactcatccttttatcagaaacacactcccatgataactcatttccctagcaacggtattaatccattcctgaaaacagagcccttatgattgtactgccccttaaaggtctcacctctcatccctgttgcattgaggattaagtttccaacagatgaactttgggggacatattcaaatcatagcaactccttattacccaaatttatcattatactggtcaacctacacattacaaatttacatttaaaaaaagtaattaagatttgctaaacttaaaagatttataagctgtaaaaaaaatcaaaaacaaaaacaaaaaaataaaaagcaaataatctttaaaaaatatgtacattttttaaatacaatgtactgacctgaaagtagtcaagttatctatagctactggttgataaaggcaacagaattgacagctcccacgtctgtaattaaatgtgtgaaactaacaaatggaaataatagagaaagattatttttctttactggtcatgttgtgacatcaatttgttttaaatgatgagaaaagaacttaaaggatttgctttttattatagtgcaaattaatattcaactactgaactgaaatagatttgcataagagttatcactatcaataatcatttgaaattcatttttcccagataaattagaatctccagtgataacaagcaagagttatctcctgcatttttgaaaaaaggttaaaataatagctatttcctataactagatcttgagattggacataaaccttatacgtgcaactttccttatctgattttaagtttcctttaactgtaaacatgagctaatgccacatgaaactaggaaaatacgatggaatttgaaaatgatgttagatagataaaagtaaggaaatcctagatttgaatgacatggaaatgtcacctagttcagtctcctgtaggggtacatagtgcctctagctgctatcatccttaatgatctccaaggaagaaagtagataaagatcctttcatcatcagttgtaggactgccctcaaccctgccccaaatattagatctttgaactctcttttagcagtaaatgttatgtaggtattaatatatatcttaaataacatatatgacagagatgatagaggtaataataataagtaatcactctccttattactctgaaaatattgtatatagcagtaatatcaaccacaatcaaaatgccatatattgagtatttgaatgggctagactctcctctgatcctttttttaaaagcatcattccactagtttccattgctattatccatgaagaaatagagacttagagaagataagtaattggctcatttccacagtttgtaagggacagagttgtaattcaggagcagaccacatacttcaaaccctcctgaccttgcatcatcatacagtaactgtgtatctattgaaaatctctagttaggtcccttctgagctttctgatctttgaattaattattttccatttctaacatttggccatagtgtcattttccagcattagtcacttacaaagatgtaggatgtgctattattttaaatccacattcatcaagaaaataggcctaattggagggaattaaggtagctgcaatttcctgatgattaagcactagaatatgttgctaggagaaactggagaattttcttttttgaaagtctgaaagaaaagtacaaataaggtttcaacaaactctaacttgaaccccagtttcctgatttgctaaatgaatggtttagagtaggtgatctcccttgggtctccccaaccctaacaacccacaagtctgtaactttaagtagcaattggatgttataacctctcaaggtcatttttagacttctatattttgcttcaatgattcttgactctctttggttcagctccacattctggagtttctttcaaatggagatctcataagagctattatttaacagtatcccaaatgtgcaatgtacagaattaaatacaaccatgcatttaagactttaacaatcatagttcatcagcactatgtgttctttctcctatttgattaaggttaaacaacaagatgatgtttcctcattgggtagcattttaaagtgtattgtgtatgtgacagatgagatcttataaatgcattaggcatgcttattttaatatctaagcatatgcaaaagttctagaaatattttacatgcaaatgtctggggctccactagggcccataatagaactccatactctgtgacttcaaagccctagtctcgacaactaatcacttggctatttccaaatcaaatttcttcaaacaaatcaaaggcatttgtcctacccaaaaaccaagttctgtggcaagtttcacatttcaaaatcaagctgcttattgagatattcatgcactgaaaaaggcacacagaatttcctttaggagatgagacacacctttttatgctccaatgaattagaaatttctcaaagagaattttaacaaattttctttacacacacacacacacacacacacacacatgcacttcatcttagcagtaaaagccaagattcagaatttcagcccaagagatctttcattttctgaaaggttatgagcccctgagatttcattcctttcagagtcataattactgtgttgcttctgagttgttaacaataacactgattaaaaggaagacaaaaaaaagaagagatcgttcacatacccgtattaagtggcttcacaaactaggagtatttttaacaccacaacatttgtggtaagtacaacaaagtgtgtaattcactgggaagcagaacagaaaagatgggaatgataatgtcaaataactcactttacccagggctccctgtgggcaaggcactgggccaagtcctccacaggcattgttgcatttaatacaacaatttttaacaatttttaataaaagccctccaatgaggcacttttactgtagcatttttacccatgaggaaactgaggttcagagaagttgaataacttgacaagagtcacccagactcccaagcctctgttcttaattgctcaactatgctactgccttttcttttatttttattattattattatactttaaattctagggcacatgtgcacaatgtgcaggtttgttacatatgtatacatgtgccatgctggtgtgctgcacccattaactcatcatttacattagttatatctcctaatgctatccctcccccctccccccaccccaccagaggcccgggtgtgtgatgttccccttcctgtgtccatctgttctcattgttcaattcccacctatgagtgagaacatgtggtgtttggttttttgtccttgcgacagtttgctgagaatgatagtttccagcttcatccatgtccctacaaaggacatgaacttatcctttttatggctgcatattgttccatggtgtatatgtgccacattttcttaatccagtctatcactgatggacatttgggttggttccaagtctttgctgttgtgaatagtgccgcaataaacatacgtgtgcatgtgtctttatagcagcatgatttgtaatccttcgggtatatacccagtaatgggatggctgggtcaaatggtatttctagttctagatccctgaagaatcgccatactgtcttccacaatggttgaactagtttacagtcccaccaacagtgtaaaagtgttcctatttctccacatcctctccagcacttgttctttcctgattttttaatgattgccattctaactggtgtgagatggtatctcattgtggctttgatttacatttctctgatggccagtgatgatgagcattttttcatgtgtctgttggctgcataagtgtcttcttttgagaagtgtctgttcatatcctttgcccactttttgatggggttgtttgtttttttcttgtaaatttgagttctttgtagattctggatattagccctttttcagataagtagattgcaaaaattttcttccattctgtaggttgcctgttcactctgatggtagtttcttttgctgtgcagaagctctttagtttaattagatcctatttgtcagttttggcttttgttgccattgctctttgtgttttagacatgaagtccttgcccatgcctatggcctgaatggtattgcctaagttttcttccagggtttttatggttttaggtctaacatttaagtcttcaatccatcttgaattaatttttgtatacggtgcaaggaaggcatccagtttcagctttctacatacggctagccagctttcccagcaccatttattaaatagggaatcctttccccatttcttgtttttgtcaggtttgtcaaagatcagatggttgtaaatgtgtggtattatttctgagggctctcttctgttccattagtctatatgtctgttttggtaccagtaccatgctgttttggttactgtagccttgtagcagagtttgaagtcaggtagcatgatgcctccagctttgttcttttggcttaggattgacttggcaatgtgggctcttttttggttccatatgaactttaaagtagttttttccaattctgtgaagaaagtcatttgtagcttaatggggatggcattgaatctataaattaccttgggcagtatggccattttcacaatattgattcttcctatccatgagcatggaatgttcttccatttgtttgtgtcctcttttatttcgttgagcagtggtttgtagttctccttgaagaggtccttcacatcccttgtaagttggatttctaggtattttattctctttgaagcaattgtgaatgggagttcactcatgatttggctctctgtttgtctgttattggtgtataagaatgcttgtgatttttgcacattgattttgtatcctgagactttgctgatgtttcttatcagcttaaggagattttgggctgagacaatggggttttctaaatatacaatcatgtcatctgcaaacagggacaatttgacttcctcttttcctaactgaataccctttctttctttctcctgcctgaatgccctggccagaacttccaacactatactgaataggagtggtgagagacgcatccctgtcttgtgccagttttcaaagggaatgcttccagtttttgcccattcagtatgatattggctgtgggtttgtcataaatagctcttattattttgagatacatcccatcaatacttaatttattgagagtttttagcatgaaaggctgttgaatttcgtcaaaggccttttctgcatctattgagataaccatgtggtagttgtctttggctctatttatatgctggattacgtttattgatttgcatacgtcaaaccagccttgcatcccagggaagaagcccacttgatcatggtggataagctttttgatgtgctgctggattcggtttgccagtattttactgaggatttttgcatcgatgttcatcagggatattggtctaaaattctctttttttgttgtgtgtctaccaggctttggtatcaggatgatgctggcctcataaaatgagttagggaggtttccctctttttctattgattggaatagtttcagaaggaatggtaccagctcctccttgtacctctggtagaattaggctgtgaatccatctggtcctggactttttttggttggtaggctattaattattgcctcaatttcagagcctgttattggtctattcagggattcaacttcttcctggtttagtcttgggaggatgtatgtgtccaggaatttatccatttcttctagattttctagtttatttgcatagaggtgtttataatattctctgatggttgtttgtatttctgtgggatcagtggtgatatcccctttatgattttttattgtgtctatttgattcttctctgttttcttctttattagtcttgctagtgatctatcaattttgttgatcctttcaaaaaactagctcctggattcattgatttttttgaagggttttttgtgtctctatctccttcagttcttctctgatcttagctatttcttgccttctgctagcttttgaatgtgtttgctctagcttctgtagttcttttaattgtgatgttagggtgtccattttagatctttcctgctttctcttgtggacatttagtactataaatttccctctacacactgctttgaacgtgtcccagagattctggtatgttgtgtctttgttctcattggtttcaaagaacatctttatttctgccttcattttgttatgcacccagtagtcattcaggagcaggttgttcagtttccatgtagttgagcagttttgagtgagtttcttaatcctgagttctggtttgattgcactgtgatctgagagacagtttgttataatttctgttcttttacatttgctaaggagtgctttacttccaactatgtggtcaattttggaataagtgcgatgtggtgatgagaagaatgtatattttgttgatttggggtggagatttctgtagatgtctattaggtctgcttggtgcagagctgagttcaattcctggatatccttgttaaccttctgtctcattgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttcgtctttgttggtttaaagtctgttttatcagagactaagattgcaacccttgccttttttttgttttccctttgcttgatagatcttctgccatccctttattttgagcctatatgtgtctctgcatgtgagatggatctcctgaatacagcacactggtgagtcttgactctttatccaatttgccagtctgtgtcttttaattggggcatttagcccatttacatttaaggttaatattgttatgtgtgaatttgatcctgtcattatgatgttagctggttattttgctcgttagttgatgcagtttcttcctagcctcgatggtctttacaatttggcatgtttctgcagtggctcgtaccggttgttcctttccatgtttagtgcttccttcaggagctcttttagggcaggcctggtggtgacaaaatctctcagcatttgcttgtctgtaaaggattttatttctccttcatttgtgaagcttagtttggctggatatgaaattctggattgaaaattcttctctttaagaatgttgaatattggcccctactctcttctggcttgtagagtttctgccaagagatcagctgttagtctgatagccttccctttgtgggtaacccgacctttctctctggctgcccttaacattttttccttcatttcaactttggtgaaactgacaattatatgtcttggagtttctcttctaaaggagtatctttgtggtgttttctgcatttcctgaatttgaatgttggcctgcctcgctaggttgggggagttctcctggataatatcctgcagagtgttttccaacttggttccattctccccgtcactttcaggtacaccaatcagacatagatttggtcttttcacatagtcccatatttcttggaggctttgttcatttctttttgctctcttttctctaaacctctcttctcgcttcatttcattcatttgatcttcaatcactgttaccctttcttccagttgatcgaatcggctactgaagcttgtgcattcatcgcgtagttctcgtgccatggttttcagctccatcaggtcatttaaggacttctctacattggttgttctagttagccatttgtctaatcttttttcaaggtttttagcttctttgagatgggttcgaacttcctcctttagcttggagaagtttgatcatatgaagccttcttctctctacttgtcaaagtcattctccatccacctttgttccgttggctggcgaggagctgtgttactttggagggggagaggcactctgattttcagaattttcagcttttctgctctgtttttcccccatctttgtggttttgtctaccttggtctttgatgatggtgatgtacagatggggttttggtgtgggtgccctttctgtttgttagttttccttctaacagtcaggaccctcagctgcaggtctgttggagtttgctggaggtcaactccagaccctgtttgcctgggtatcagcagcggaggctgcagaacagagaagaataaaaccagaagtcctgggaagaagagtgatatagtctggatatttgtccctgcccaaatctcatgctgaaatataatcccccatgttggagctagggcctggtggaaggtgtttggatgataaagactgatccttcatgaatggcttgggacatcccctttgtggtaagtgagatcttgccaagttcacatgagatctggtcatttaaaagtgtgtggcacctccacccccactctctctcatttgctcctgcttttgtcatgtgatgtgccggctaccccttcaccttctgtgttgattgttaagttttctgaggcctccctagaagccaaccaggcgctagcaccatgcttcctgtaaagcccgcaaaaccatgagccgattaaaacacttctctttataaattacccaatctcaggtatttctttacagcaatgcaaaaacagccaatacaaagtggtaactaacaacatgaaaaccagggtaagcttagatccatgctgtatttatacaggctggcccagagccaacacttaatacatatttgttgaataaataaattcatgggtgaattcaagacattgtaaaataatttatggggcatactggccctttgacccccactagtcatccagtccattccagcatctgtcagttagttgtccatgagtctgtaatggaacctggcttccactcccagagccagctctgcacaaatttgtgaagaacaaaatgcctacctggcagcctctaccttctcttgttctttgctgggactgctattttccaagcctgtgttctctttcacgctggccattgactgtccagaactggctgttgactgtccagcaggcccagggcaagctccactcatagaaattgtgtgatcatctttcttcttcctttcttttctctattccagtcagaatttcagcatttctggaagcaattgcttgtttgcttatctgccttcttcttcacacagtaagatatgtgaagacaggagctgcatcattattatatctccagtgcctggcatcgtacttggaaaaaagtagttgtttagtcaacatttattacttaaattaatgaatgaatgcatggatggatgagtgttctccattgcaaacattgcttatcaagattgcaggtatttgagtactattactattaattgttatggtaatattgaacttatttggaagtattactgttggaagaaacatattttgcaggtgtgtgtgtgtgtgtgtaaaactattatgttcctcatttattcaacaaatatttattgagtatgtactatgtgacaggcactagggtatattattatgttgttgttgaccattatcttccaccatccctttaaatattttaggagagttctctctctctctctccctctcgctcttgctcttgctctctgtctctctcttcccctctttctctttttgcatgtggatgaaaattccaaaaggatctataattttctgcataatagacatcctgaaatgccttgacgtcagaaacacagtctcaattcaggaaatatgatttgcagttccatggaataatcaaaactctgaacttgagtaaatattaagccttctccacttccaaaggtggagccctgcttcaaggaggggtcacgggacttaggtgcgttctccgccctctccatgctgacctcttttctcacctgatctgcccagctcagggctggacaagaggtgggagggaagaaaagtggataggaccttagtctcactagttcttactcgctgttagttctctgagcctggcgtatagttccagttgtacctggttgaagaagcttttatgtcctcttcagagatcccccgacaggccatttctggtgattcttccctaagccccaggtagctggagggcacataccctcggtgtaaatcttccagacagactttcaggtatgatgtaagaaaatcccacacttgctgtctcactcacatggccctcatatgcttcatgggaaacatttacatccctgccccgacagcctctgggagttaggggtcagttaggcatcagtcctctctatctcctgacccgaaaatagcccacggacctttcgatgaccctcttgcatgtcccctctccagacctgaggtagaaataggaaggtggagatggctagagaggcgagagttttctgatgagattcctctcctgactctcctgctcaccacactctaggcctacttgaattctcaaagcagatagtaagttctaggatccagagacttaaaaaaaaatctgcatttagtaggttggccttggaaatttccattttattttgtagtctccttagacacttcaattttgggcacattattgtatatagtatatgatatatacttatatgttatatattatatataagttatatgagatatatatttatatatcaatatattgtatagatagtgtgtgtgtttctatgtatctcaagtgttttgaacacaacttgcggaatgcaataaaattattttgccacctctccctttaaaatatattcagttctttctctgctcctggatgaatactccacttgggcattctcagagcttttctaatatctcttggagaatagaaagtattctggtctcttaaagaataaaatgttgccacaatttgatattttaagtgtccagttccacgtaatagtcaaacctcccatcttcattcaaagttacacctactccccgtcttcccagtgggcctgcagtctgggaatatgatgcatttagtttcttttttttctttttttctttttttttgtttttttttgagacagagtttgactcttgttgcccaggctggagtgcaatggcgtgatctcagctcaccacaacatccacctcctgggttcaattgattctccttcctcagcctcccaagtagctgggattacggacatgcgccaccacgcccggctaattttttatttttagtagagatggggtttctccaagttggtcaggctggtctcgaactcccaacctcaggtgatccgcccaccttggccttccaaagtgctgggattacaggtgtgagccaccgcacctggccaatttcttttctttttcttgctcctcactgccctagctagctgctatttatagaccatttggagttgaagcaagagggttggaggagaggcaagatcttacatcaacagttttgctgtaagctggcctcatattttctgggtctggccaatattaaaactctttgtctcatgggatactttcagaggttctttgaaatgcccatcccaccactgtgctgggaaactttcagcagcacagttctcttgatacagatcatgtattttcctgacttgtttcctacttcttccacagtctctaggaattgggaggtggtgttcacccctggcttccacatgctgagttttcagtctcccatctcaaaggccccattgagcaggatggagtaagcacaacctcattctgagtgccttgtttgtaggcctgtgtttaatctaagggaaacataaaacctctactcctagaaactctaggagacacatctgccattgttaccactggaagtgagatgccagttcactatatctccccagctacagggcatagataccaaatttccaagagattttgtcagaatctctttcactagtagaagtgaaggggcaagcactcctttggaagagggacatcaaagtacagttcttgctaaagaaattccccctcaaattctttcttctctcaaaccttttatatcctcagtgtgcctgaattgtctacaagccatgtaattagtttttgttatctctttttcaagtcctacaggctggcctgttgcatagatcattttcgtctctgataaccgtgaaagctgagtgttcagccaaaatttccaattaaacatcctgatatgtacataattagatatacacaactgtcctgtggcatcagcagcatatattgttattcctgtttgatgtatgagtaacctaaagtacagacaagtgaagtaacctgcaccatgactagttgggttttctcactccatgtcttcactctttccctgactgagttaacacattgtccttttaagaacggactgaaggtccagcgagtagatgaacagaagtaaccttattggtgttgcacaggcctacaaaattactaagaagtccttacaacaaataaatataacacatatttcatgggaagtaaaataaaatagtagacttaatgatggtttagaataagtagtattaagtaaggaaaatagactgacataaaaaagaaacaaaaaaagactgaaaaatataggtatagtaaaaattaaaagaaaaacattatctattattgaaaattaagcatctgattatgtgataataaaagcttaacgtagtttgcccaggtttgaaagaaaactgattgacagtcgcttatcaccaataatgaaccccacctgtgccatagaaagtgtcttgggacaccaaaccacccgccaacccccatgttgtaacatcacagtagtacaaggatgtagatgcaccaacctaatttgaatgtgaagtagtccgtggtataggacagcatacgtacaagcccaccctgagggaaatactgagcaagaatctaggtgggctgaaaataagagaatgaataaaggaaggagaacagggttaaataaatatgtgagatgaagcatatggtttgagaagttttggggtcccacagatctattgcagggtactactggtaatgacactcatgaaccatgtaccttcacctgttctactaactattttcttgagtaaagaggtcatcttctggtgccttgggattgggactgcttaagtcatttctaaccctacattcttacttccctttagggttaggcctagaaggagaaagaggaaggacatgaaacaaagagttgacaccttctttttttttttttcttattttaaaggtaccatcagacctctcttatacttcattttacttcccaccacattcaatttcagattttttgttcaattgcttatatcatttagcaaccattcaaaattgaatgctgcctttggaaataaagaacatctgctctaaatcttgttgtgctggagattttgcaagaagctagagaggcagatgctgccatatagagttggcaaagtccaaaagacatgacttacaggcacaccaagcctagagaaactgataagaagtagtgctgcaaaataacccttagaggaggacttgtaaagcaaaggaatttagaggatactagaagtagaaatgtgatccaagtatgaaataaaaacacaatagctacagctataataccttcgcctctagtctcttttctcaagcctagtcttcactcctgattttgcactgtgatctcaaagtactgattcctgattttgattgaccatttctcaaatttcccctattaatttggaatcttctagttttctacatatgggccttcctggaccatacacagagaatgcctctctctctgttttaaatgggataacagatatagatgttatctccccagaataaaagagagtacaaatgttgggtctgacttctgtcttattattattcagtttggtctgatttcaggatctgtttaacatgtattgatttatctgttaggcccactttgtcattttaacatgcatattaaaaaaagaagaggtattgaattcagccattcagatctttttcaaattggaagcaacttcagaaatctccacaatctgaaaatgttcctgtgtgtagggccatttcctcaggggatatgaacagtttcatgaagatgtcccacacctccagatttgtcctctttttcatcagagctcctttcttatctttgcctgggcccttaggagggctttctgccatgtcagtatcctgtcaatttctacaactctatgaagtttttcacatagtagaatatattgtcaaaatgtcttgatgtcttattacaacctttacccaatctcggcagcaggatttctgaacacactcctggtgcctttttcctgatacatttattatctattgtgagagttaaatggtatctcgaccacatcctgttcttcctagaatccatatcaccttaaacatctagtagtctcatttctgacattctggtggggaaacctatttttaggtaaagttgcttatttttgttggaggaacgtttgattttactaagtctcttaagtttcttgaattaggttttctaatctatttgttcattcacaaatatttattgagtgtatattagagttctccaggggaataggactaataggatgtgtgcatgtgtatatatatatatatatatatatatatatatatatatatacacacacacacacacactttccctactttcttccacttattacccttggctgaagcatgaaaatatatttcatgtgtataaacacacacacacacacacacacacacacacacactttccctactttcttccacttattacccttggctgaagcataaaaatatatttcatgtgtatgcgcacacacacacacacacacacacacacacactttccctactttcttccacttattacccttggccgaagcatgaaaatatatttcatgtgtatgcacacacacacacacacacacacacatatatatgtaggaagagatttattgtgaactggctcatgtgattatggaaattgacaagttctaagatttgaagtcagcaagtaggaaaccccaaagagccaatggtatagttcccatttgaaggctggcaggcttgagactctgaaaaagcagatgtttcagtttgagtctgaaggctgaaaaacatgatgtcccagctcaaggcagtcaggcaggaggaaattccctcttactcatgagaaggtcagtctttttgttctattcagatcttcagcagattggatgaggcatcccccacattaggaagggcaatctgctttactcagtctactgattcaaatgttaatctcctcccaaaacaccctcacagacatgcccaggataatgtttgaccaaatacctgggtactccatgagccagtcaagttgacacataaattaaccgtaacatgtacatactgtgtgtatgccaggtacttacttaacagatccttttttactgttaattttattattataaatgtggctgagaaaacagtatattcttcgtaatattgttgcaaatgaatcaggcagatatttaagggtaggatttcttgttctgttgggaagatacgtatgactgcctttgtcatctcaaacaaagttgcaaaaagtgtcatgacttagggtaactaatggtaagtaccatggtaatcaatccctaaattttctagtttaatttaaaaaaaattatttctaacttacttcactgtctgatgaaggccaggaaactctcctaggtaacttacctccaagttgtagaattcaggcccctttcatgtgtttaaatataacctttttttcttcccctccaactccccttcctaaagataaacttttaaatcaataggtatctcacagtactttgtgaaggaaggtaaaataaagtcaactcgaaaattgtatatttaattgattactgacctctataatttaaaagctgcttgatcttggacaaataattctttttcattgatgatcttggaacccagtgggaaagaactacagaacgaaatggtaaatcaaatatcgaagatgttttgttacttgaggaatcttctgttaggttggtatagcggaggaaaccttccaattgagttttgagtttaagtaacaagttttgctcatcaagctgggcaatctgggcaaaccaattaaccactctgggctttggtttcctcatttgaaacttagcatgttagccacactgattttgctaacatcacttccaaatcaaaattgcaattattctagtagaccatctctttagatctggattaaggatgaggcctacttggaggtgaaggaatcaagtagaaagatgtgaaatggtccctccctccatatggaaaaatctgcctgagatttagacagacactattcaaaactgtaagtccactgagcaccaactgcggtacaaaaagttaagttcccaggtctcatttacagagtagtagctgcttgttagttatcacacgccagtgattcagctggagaagctaaggcagaaggcaattatgtaaccatcacaaaagggtatgggggaagcacttgaacccataccgggcattctggcttctggtcagatgcgagggatggattcaatgtcattttaatctttattcattgtttcaatctgttagaactgttatagtttggagctccatacagaatgcagatttgttcaaatgacttcccaagaacttgtagcaagagcacttggagccatcctggacaggcccatgctgtgcctcacacatgcacagcatcttcaaggggtcatacagaaactgcctccaaacctccccacccacttccactttgccacaaccccaagagaggacacccatctcaaaaaggtttgctttcctgtggagtaagaggtataattaaattgtgtcccagcagtgaaggttccttaatgataatgagccaaaactaattgtattgatttgtttatcaccggcttaggaggcccatcaaacaaatggactgagactatttccatattcttatctgttaggtaaatgagaaacaaatgacctctccctatgtctgcatcctgaagtcactgccctctaaggctgagtgctctatggcttcgggtgggagctttgtccaaagctggggccattctgccctctggcttcttcaaataggtgaagaaagttgaaaattttggtattcattcttctatttttcatttatgtagaaggatttgtttttaacagttacaatttggatccttgccaaaggtgccagatggcctgctttcttcgggagagctggtcatgagtattaataaccctaatttggaattctctgtggaaggggtagccacaagatttggagtgggaggaaatgtagaatcattgataacaagtgaattcagagaaaaagactcttgaatcttggtcaggagtgagacataacggtaggcaggcagctttggggggccacaggagaagcctgatgtacctgcacctacccctcttagtcttggggagccttcccaatctactgctccacaaattaagagaaatagagagaattaaaagagagctctggaagagccatagcaaagtccagagttaggttattgagctcaagtggaaagggataaaataaatggcttccagaatgtgaagaaattagctgcaagaatgtgaaactaaacagtggatctgtgactattcactttcactgagatgaaggagcaaagctcaacctagtatttagaaaagatttagggggacatagaaagaaaaccaacatctattgagttcgtgttctcctcccgttacttggctaaagagtggttaggagtgagcctgacatatattgtttctttaattcttttgcctagcccagcaggtaggtatacatatcccattttggagaggaggcagctatgtgtccagttaatgtttgtaaatttaaagccactatcatctgcatcaaagcccatactctcaacggctgaagactgatatctcactctccttcctcatctttccaatagaaagcaaggagttccattcagcacctctatgtgggcagtattgaagaggatgagcctttcttcctgtctcacttgcccttacgctcttcaaagggagggcctcatctgaaaagggagatagcctgaagccctttgactgcattgatcagggacaggaccatgatattgttacatacctaggtcaccctatggctgagctctctcttatgccctttacaccaatctgtgtcctgctccaagggccttgcccctgtgactcttattcagtaaacaggccacacagctgcttctggtagcccaggcagaactctgagcagaatcctggtctctgtttcagtttgcacctggtggccaagtcagagttgtaaagtcccaagatttaagtttagagaaggttgtcagagatcctttcatattccccaattccttttatcataaatacagctgatgctctattttcatcaccagtttgctctttctttttatcctcaattgattagattccctaggaaaagaggagtgagtacataggtaatttttctaaacaccaatctctactactgatgagacaaatggggagctttccaaatgtgagggtcattcaggtgacctgatggcttatggtgactgggatggtttaaagagaattttgattaacaggagaaagagttttttaggaaacctctaaacttgcttgaagctgatttagttgatcctgcaaagctgcgctatttttcacctaattcgagagtttattttagaggtattcatcttctaaaaatattttacctttaaccaccattttcggacataaactactttatcatttatgtagactttgaggagttaaaagcttttggtaaatcttgcctcctttgattcgcaacaaagcagaaaaaaaaaaaacggagaagaaatttcctctttgtaaaggaaaaaatttatttaattttaaatgacttgtccaaggtcacttggctggaaagtgtctgggaagagactctgcttttctgtgttctgagttggccttaaattattgcaatacttcacatacaaaaataaaaaagaaagataaatttgattatataagaatgtaagtctcctgcacagccataaatattaattaaacaatataagataaataacaaataggggagtaatttaccccactagacaacagggttaattttcttaatatataacaatctccttgaatagcaataaaatgtataaacaaccaaatacaaaataggcaaagaaggaaacatgcaattagtcaatgaccatgaaaagatgcttaaacttatatagttaaagaaatgccactgacttatcatttttcactaactggcataattaaaaatcttgatgtaatgttggtaagaatatggggaaaaactgttggtgggagtataatttgagacagcttttccggaagggaattggcagtatttattgtaacctattagtaatgtctgcaatatctggtagggtgtgaacattgagttccattagcagaaataaagtattcctggagttacaggataaagcacttatcaaaccacacagagtccaaatcatgcaaatcagaaggcttcctctctaatcaccttattaatcccctctcttagcttcctccacagctggtctttttatctttcaggtctttcccaggtttgcagcttccacgttctcggttctactcagttctcctttggtaggagcctgttttgttctttggaccttgggctttagtggaggggaggggtccttaggaccttcacagtgaaaatgtactcagtaataaaacatttcccttgctgattttgactactacttataattcaaatgtgctatgctaatagaacctccctcttagtgtgcaagagagaaaatgaaggaggaatgaaaaattataatcaattacaatataaagtggcccagaattgacagatggaggaatctattccatggatgtacttgcaacagtatctgaagatacatctgagaaagtaattgaaactttgtaattgcagaacataaaatgtaaatagccgtaaatagacaaccgacaaaataaagcatggtgaatttctaactggaatactatgcgatccttaagaatggggcagatcttccattatgctctaatagaaagttacctagaatacaaaagaatctcatcttcttcaatgtggagatttaaaaaaaaaagcctttggccaacttaaatatacatgcttttagaatcataaatgaaattattgaatgtttacttatatttaatttattaatctagttacacattcacatttaagattgcatatcatataacctattacttcagaaatatttctactttttgcatttcttgaatcagtattatatgaatacttcacatacatttttgacattagtcttttacaagctggagctgctttctgagtcatctgatacatattttttcagagtacattttccttatttccatctgttacttgagatacagcatttgttgacccacatatgatgctatcactggcaattttatcacaaactacaagtacccattcatagaacatcagtaaaactgttttattaagattcattctgtagggctgtatgttggatctcacaacacaactacttattctgttgctttgtaaataatctttgaaaggcttgtttttacaattttaagcttgaagctttttgtcttactccaagaaataaagactaatctgtgataaatttattttccccttttaatcaatgtcacaggtgaccacaataggtatacaaactcatgttgaccgagattgtttcaggctaatgtgtctttcccaaacaataatctttagttcaaaattaagtaataaagaaagcttctcataatctcagagactttgcaaagacctggtgataattccctttcttttctgaaagataattttagcagagtaacctcatcatttactcaggcatttgtggaatgtatatagatgtacactcaagtattcaagatatattctgaagtaaaaggacagattgtagaatagtatttacagtgaacccatttgtagaaaataaaaaggctacaccagtaaatgttatctataattatatgtaactacatattcataaacccttcctggaataatacattgtgattaatcctaaggtagtggggggaagaccccaggaggaggaggaagactggaatgttttctctttttacccttgttccaatgttgtcagtgatgtattaaatgaaaattggttttaaaatacatgcctttccttttacttcctcccctctccctccccctacaagctatttctcatttggagttttgcttgctattatcttgagccaaattaaaccagtgatctcctgatggaaaaggccagagcctgttcaatgactccagcccctttcctgtccattctcctctggagccatcaccaaagccctggtcacactctgtaatttgtaaatcctgaaattgtggtttgcaaggcaaatgattcagagcaagggctttatcccgggatcttatcctcctagttgcacaaaaacaaacaccagggacaagaaaattccttccttccttccttctttcttttttcgtcttctctttttattctgggtaaagggagctaaaaagcaggagaggaggtcagtttgtggaaaatgaactgaaggaagtgaattgtaagagatgggtcaaagaaagaaaaaaaaccacgcctaataaggaagctaactgcagtttttccaaataaattaaacgaaagataaagaggcaggctatcaaggcagcctaaataaggacacctcaaaaggaagaacgaggaacaaagcttcagaagcttcaacaggagaacaaagaggaagaggaagcggtgtttaatgagtgcacagtatgaagccggaggctgactgctttggtttgctgttagaatctccagctaacagtgcctaaacaataaaagtttatttcttcttaagacaagcagtctggatataggcagtcactggaattgattcaacaaatcaatgaaatcagagctcctgatcagttcagcaatttctgtgatacttttctcctcttcaatgttcccacgttctgagacggctgcagcagcatcaagcatcacatactcccacaatccactttcaaagccttgagacaaagggcaacacaggccagtgttgctcctcctgtgcgcctcttatcaggaaaaaaaatatctttctcagagccccacagcagcctccctttatatctcatgggccatagctctgtcacaagctcaccctgttccagggattgcctctacctatttgagatcaagggatctcttcctgttacctaaagaaaaattagagcactgttaattagcaagaaaaggtgatgtcttggaaaaagcagccaacaacttctgccacattaaataatctccataaaccaccttttgaggtaactattattattgccatttgaattagtttgctagggttgccaaagaaaaagaccacaaactgggtgcctgaaacatcagaagtttattgtctcatagttctgaagactagaagtccaaaatctggatgtcagcagagttggttctttctgagggctgtgaggggcagatttgctctagacctctctctttggcttgttaatgagtcttttcactatatctcttcacataatcttccttctctgcatgtctgtgtccagatttcctccttttatagagacagcagtcagattggattaaggcccatcctaacaaccaagtaagttaacaatttcaacttaattacctctataaagaccctatctccactttctgaagttggggggtaagtatttagacgtataaattttaaaagggcacaattcaacctgtaacaccattgtacagaagaaaccgggtagtagagattagataacttgcccaagaccacagtagctccaaacgtacacctgccttacaacaaacttgtgttctttccaccataacacaagaaaacaaaagttaataagtgagaaatagagtgaatgaacaatactaaaatatttctaatgcatatgacagaggtgtaggactattataaggatgtgtgggcaaaaatacagattttcagctaaaacattttaattcgtatctcagtgtaggtaaggttgaaattaagagttgtacgctaaataacctgaaacggaacttacaagttgggtgctttaagctctatacaccaaaatcaatgaagccatgaaaagaatataaggaagggggcagagaggataactggctggccagcactgtcagcaagcaggatttgccaaagagaaagtcatccaatggcaacacctctctcagagctcactctcttgccttcacttctttgttctgaatgtgtgtcccactgattctcgcattcctacaaacttgcatcctgactgcccaactcccctccatttggcttagctctgccgcagtcaggcaggaagaacgcccactggggcctgctcatttgcttttacagttttataccactgcaacttgctatgcctctctttcccacatctagggcaccctttagataggaatgctgggttcattcctgctgaggtgttactgactggtaatagcaaaatctgttcctgtcttgcaggatgaatgtgtacttttacagagaatacagtctcaattcaaagaattcttaatatttttttcccacaaagtgggtagtctaataagatgtagaggagaaggagctttgagaaagctggagaagtcttgaaatctggacaagtgtgctagacactgttagtgactgcctgctctaaacattctgttcattgcagtagcaatagtagtagtagtaatcagctgaaatgtgtgtttggtcctaatcaggactgaataatctggaaagtctttacaaactcggctcaaccatcccctcttccagaaggcttccctgactacatcttgttcactttctgggttggttgtcctctatggcatcctcacagttccctatccattctaatgcattgtcactgttggtttattggacattcttccccaggcaaccacaaacttttcagaggaaggaactgggttttttatctctatatggcaagtaccaagcccagaacctggcatgttgctgatatttgtattaggttcctaggctgccatagaaaattcggtggcttaaaacaacagaaatttattctgtcacagttctggagaccagaattcagaaatcaaggtgtcagcaatgttggtttcttctggaggctctgagaggcaatgtgtcccatgcctttctcctaaattctatggctgctgactacacctggcattccttggcataaagcagtgtaactcccatctctgcctccttcttcacatggaatttccctgtgtgtctttttatctgtttcttcttctcttataagaacttgtgattggatttaaggcccaccctaatccagggttatatcatctaataatgatccttaccttaattacatctgcaaaggcctttattccatgtaagacgacattctgaggttctgggtggacatagttttggggagccaccattcaacctgatacaatattgaataagtatctggggaataaataaatgaacagtcaacatggctccaatatctagtgtgaagaattatactttcataccacatgaaagtaatctgtatttaaagtatacaagaaacccaactgatgctcgaggaacctttatatgcttgtgttaaatggtaagactaagttactttgggctttcactgtatagagtcttagatttgaaagaacctaatgtgttctttggccctggaatgtgatagatcatattaaagtgaggttttaatattgtaagatttatatgatttgctatttgagcttttctaaactattaagtagtagtatctattagtgtcaatactaggtattcagttattttaataagaagcatattaataggatcacatgcactgtcatttttttctatcgtacttcagatgtggcctcattcaaggatagagcagtcagaggcttccagtatttctctctcatacggtaatttcacacttgaaactcagcatacacaatgaggaaatagatatctttccgtcatagtcctgctaaacagaaaacaattctctattagttaatgtggccaaatattttctggtacctagtagaagcattatttttagtagcgatagaagcaggaaatgggaagccaaagctttttttttttttcagacagagtctcgctctgtcacccaggctggagtgcagaggcgcggtctcagctcactgcaacctctgcctcccgggttcaagcaatttcctgcctcagtctcccgagtagctgggactacaggtgcgtgccaccatgcccagctaattttttgtatttttactagagatggggtttcaccatgttggccaggatggtctcgatctcctgacctagtgatccacccaccttggcttcccaaagtgctgggattacaggcatgagccactgcgcctggccaccaaaactatttttaaaatttgggtatatgtcaaatagcatttagacattaatcaaactacagcttgtcctacatcatcaattattgacaccacagggaatgattgtcattcacttataaatagctccaagcaaaacctagacagggtccagaatggcaagactcagtctaactttagaattttatttccaaagaagcaaagatctcaataagtttggaagtagaatcacctcaacatccctggagaagcagatctagtccctctggctgtgcattgcttgaaatgcagtgttgtatcatatattaaaacactgaaaatggagttcagcatggagagccctaggctacactatcatgaatctttcacctttgctaatcttaaagtcagaaataattttaaaatagatgcatggggcaacgtgtgcatggggaaagtgggtgcagcttaaatttcagtgccaggaacagtgtcgatttggccattcatacctgtcaatagctgctgagggtaaccttcttatttaactgcagagaaaaaaaaagatgaaatatgttcatctcctaccttgagacataatcattatttaataaggcactatatatgaaacatgggctttatttgacacatggatatgctaataagctccagaatattgctaggctctttgaaatggaggctgtgagatcatgatagtcagtcgcttgtttacaatacatgtagaaccctttactctgctgaatcttgaggcccttgcaaatttgtattagctgatgtctacgtggtgcagggaaagcaaccatttctggtactactgacatacgacagaagtgatattgcattaaaatggaaaagaaagagaagactcatatcccaggaaggaaggaatctgggcctgtctcaggcaaaactgtgaattaaatgaaagatctctaaaacttcatatcttggcctaatggtcacttttttctttcagtggtctgcttaagcagattttaattgccctgaggctttctttccctggctgtgtgcatcttcccagtcacctttgctgaggttatcaacatagcaaaaccctccctaggttgtgccacatgctccagactttcccaacccatttctcaaaaatatcaagtaattactgcgtttggttccatattgggggatttatctaggaatatatcgacatgcttttctttccaagacacatttatacttgaaggtagactgcgaagttttattccaaaggagacactaataaagggcgtttcaggttccaggcaggtgccttggctagtgaaaagaggcagaccgcggtagacaatatgtctaaagaagcttggatcagatgacaacactcaaatcatgtcacaaaggcaatcagctgtcacctctccatgtagggaaggccgtggagaaatgactggaagtcaatagaagtaaatatatatgaatgttgacatagtggagtggagccttggagcatgagtgaaatagcagaaataaatatttaaagtgaacatttctttgggaacaatgaaaagtgacatgcagttgagctctggcagaagttttcagaaagaagcaagcaggatcaaacacatgcctctgctgttcattatttcacaaacagacaaaactcaaattctgactagtccagagctatatcgctcaggagctgctgctagcttcaatcctgttggtcctaagtataaggtaggtgaacttggagggagaggtcgctggaggaggtaatatggtcaagtaaccagtgacacagctcaagaaatcatctttattggacatatttattcttttcacttcttttttccttttcttttttaaaataaaacagctttattaggatataattcacatgctatataatttacccatttaaagtgtataattcaatggcttttagtatattcagagttgtgcaatcattctcacaatcaattttaggacactttcaccactccaaaattaagccgcatacctcttagccaacacctctcaggccccccaacacttgctgggcccttgaaaccaccaatctactttctgtctctataggtttgcctattctggctattccatataaatgcactgataaatatgtggtctattgtgagtgacgtaatgttttcaaggttcgtctgtattgtagcatgtatctgtacttcattcatttttatggctaagttatactctgtcatattatggaaataccacagttcatttatccactcatcctctgacagacatttgggttatttctactttttggctattattatcatgtggttatgaacattcctttacaactctttgtgtggacacaggttttcctttctcttgggtaaatacctagaagtggaattgttaggtcatatgagaattttatgtgtaggcttttgtggaagtgctagactgtttttcaaagcagctgtacccttatacattctcaccagcagtgtacaagggttccaatttctccacattctaaccaatatttgctattacttgtcttttttattatagccatcctagtggatgtgaagcagcacctcactgtggttttgatttggactttcctgttggctaataatgttgagcgtcttttcatgtgcttattggctcctttcacttctttaccttgactagtagactcgccttagatcagcggtttccaacctttttggcaccagggactggtttcatggaagaaaaattttccatgaggtgtggatgtgggggatagcgttagattctcataaggagtgcacaacctagatccgtcgcacgcagagtacacaacaggattcgtgctcctgtgagaatctaatgctgctgctgatctgacaggagatggaactcaggcagtaatgctcgcttgcccaccgctcacctactgctgtgttgcccagttcctaacaggccagggacaggtaccggtctgtggccctagggttagggactcctgccttagaggaatttggcccactactatagttatataatgacaggaaaatttcaacattctaatctctgtggacaggacagctcccagagtctgcacagaaagacctaggaaggcagcattgtgtttgaagttcggcacctgggacccagtattgctgaagcataaccccccggagtctacccctacagccccagtgttgctgaggaaggcatccaaagagacttcgggaagggtagtcagagaatgcagagagcttcacagcaagcaccagccaggggcttagctggaccccaggtttctaggtgatcatcaggtagcatatactctgtgatcttctttcatcctccccatttattctctacagttttacagctaccggaacacactgtcacttttacattatggaaaagttgaaaatattcagctgatttctgagaaactgggcatatttctcattgaagaaccaataagaaaattttttgtcacatcaaagtagacataaatttccaggataaaccagatggtgagtttagagtgtcaacttagtaaggacaatatgcatttagaataaatactttaccaagtaggacagaataggctaggtctgggatgcttctaacatgagtctaagagttgaacagcttgtcatttttcaactcgtcgataaatgggaatggaattatttattctggaaacaccaacagagttgttcgtcaattgttgatgtagtgtaaaatgattttaatgcttgtggtctaagaaagtatctctatcactcagtgcagtctaggacaaataaacaggcaaacaaacaggaaaacacaaattggaagataaataaaaggggcagcaggcagtgagtagttgttacctaatttgcattcaaagaatggtttaaagaatattggcaggaatccagtaaactagcttgagtcagatgaacttcatattaagaatgggtggaaatttataatattggggtttggctgatgctacaggattttcttggtcagaatcataaaaagatagagaagccatgctaattctgacactttgaaatgtaagagcagttcttgaggtattgaatctacatgaaagggatggaataaactggaaatgatttataccaacgagatttgagttaggggaatgtgttagttttctattgctgctataacaaattatcaccaactttgtggtttaaaacaacacaaagttattttatacagttcgaagttagaagtctaaaatgggttgttagggctgcattccttctggaagatccaagggagaatctatttctttttccagcaaaaaatgcaagactgcctacatccttggctcacggccccactccaccaatttctgcttccattctcacatatcttttcctcacattgctgtttctctatttctcttttaaggacccccatggttacattgggccagaataatccttcaaattcaagatccttaatttaattgcacctatgaagtcctttttggcatgtaaagcaacatattcacaggtttcaagtattagagtggggatatctttagggagctattattctatctaacacagggaaaaaaaggattttctcagtcctttaagtatcagcctgacggtgacagaaagtaagtgtttgttttctgagggctgagactgatcctgtagggcacagttaaaacatagtggttctgccctgaagtgtcatctgctgctgatgaaatcaaaggcttggatggcatagcttttccctgttagagtaagtaatcacagcattaataggtaggacatgatttaacccacagcatactaggagctctggccaacaactttaaaatgggtcttcaccatttggaggcatgattatgagctaaaaatactacgtgtaagatattgtggcctttgatttctacccttcaccaaaaatatcttgaggactttgtgccaggtgggtgctaggaaaaaaaaaaatgagacacagcctttgcagtctagaagccagcagccagttattacacataaaacacaagaacatattatataggaacaatagagtgaggtatggaaccagagagacggaacctagaaggatggtccaagaagtagaaagtgaagacagagtatagtggacccaagaataataataacaacagacagttatatggtgtttcctctaggctatgcactatctcagatctgtacacagatgctccttgacttatgatggggttatatttggataaacccattggaagttgaaaatagtggaagtcaaaaatgcattcaatactgtacacctaaattaccaaacatcatagctaaacctggcttaccggaaacatgctcagaacacttaaattagcctacggttggacaaaaatcactaagcacaatgtgcattttatgatgaagtgatgaatgtctcatgtaatctgttaaatactgtacaggaagtgaaaaccagaatggtcgtatgagtgctcaaagtacagtttctactgaatgcatgttgcttttgcataatcataaaattaaaaaaactgtaggtcaaaccatcataaattggggactatctgtatgtattaactcatttaatcctcataacccaagcctggtaaattggcttcccagatggggtttctcaaacacatctctattttccctcccagctgttaccactgtagttcaggacatcagggtcttttgccaaagcttcctatctagtgtccctgccctctactcttatcctacaccaaagtgatccatttataaagtaaatctaactgtgtgacttaaaacccttcaaatcttgctcagaagagagctgacatcctttaactctcatttgaagccctcaagtgtctgacctcagtcctcctctctgacctcacctccaccttctcttttccacccactctcatcagttacaatccagaaagagtggattccgcctcctggcaggcagctgtgctgtttcaggcccatggacctgcctccaccttttaccttcccccactcactaactcctgctgctgctcacatccctagcctgtgtgcggtgcccctcccctttcctcccacagtgacctgagcacagctcgggtatttatgcctctgttctccccggtaggtttaaagattctttagagcaaagatacagaattttcatcttcccttttccagcccttgtgcagtacctggcacataaaagccattcagccaatgtttgttaaattcagctaaactgagcaggaaacgtctcccttgtgtgtggctgtgcctttttgccattcagagagaggcagtacaatcatggtgatttgaggacacttaaaaatggaaagggctccacatcgaaggcctcttgaatatagtgaaaatgaatatcaaaatcaatatgccgttcagtttagggatatgaataaatgatttcaaatgaattcaattttcctctcaacattaagtggtgaaggaaaataaattattggataatgtatttgaagtaatagctctcttctaactgttcctacaatttgttgttacttgtctttggacctctgtgtgtcatgtgatactgtgtgtcatggcgatctgagaaatatttatctctcctcaccttctaaaggtcagagactgtatcttaggatccaagtttggaattatttcctgacattaatctcttcttcctctgtgctcccataacataatttcttctttttaaatggttgttttaaatagaaaaatgtcgtacttgaatattttgatttttatgggggaaaaatttactactatgaaaaaaatagaataaaactatgtgaaagaacgcctccatttctccttcaaacccacactgctgtccacaggtaatccctaataagagtctgttcctttttctatgcatgtatgcatccatgcatacaccatgtatttatgtgttgttttttgttgcttcttgttagtagataaaattaaaattatactctcagtattattctaccacttgagtttttttaagatgatacttctaaaacttttttattgacacattttataattacacatatttatggtgtacaatttgatattttgatacacatatgttgtataatgatcaaatcaaggtgtttagtgtatccatcacttcacagtggtggaacattcaaaagcttctcttctagatatttggtaatacacaataccatcctattaacaattgtcacctactgtgcaatagaacaccaggacttattcctcctgtctaattgtaactttgtacccgttgaccagcctctctctatcctcccttcttgctcctctccctaatctctggtaaccactgttttactctctgcttctattatatcaactctttatttatatacacacaaacacacacactttttttcttttcgataacagccattctaaatggagcaaggtgatgatatcgcattgtggttttgatttgcatttccctgattattaatgctgtcaagcattttttcatgtgcctattggccatttgtgtgtctcactttttcttttgaaaaatatctatttaggtatattgggttttttttcttttgtttaagtccctaatatattctggatattaactccttgtcgaatgtatagtttacaaatattttctcccattctataggttgtctcttctctttgttaattgtttttcttgctgtgcaaaaccttttaagtttgacataattctatttgtctatttttgcttttgtgtcctatgcttttgaggtcttatttttaaaatccctgccatgcccaatgttgtaaagcattccccctatgttttcttctagtagtttcatagttatagactttacaattagcctttaatccatttagttggattttgcatgtggtgagaagtaagggtctagactcattcttctgctcgtggatatcctatttttccagcactgtttatttaaaacactgtcttttctataatgtgtattcttggcacctctgttgaaaataagttgaatgtagctaggtgaatttatttctgggctctctattgtgttccattgatctgtgtgtctgcttatatgttagtaccataatgtcttggtacttacagctttgtaatctattttaaagtcaggtagtgtgatgcctccagctttgttctttttgttcaggattgctttagctatgtcgggccttttgtggttccatataaatgttaggattttctttttctatttctttattttgataagaatttggtattttggtattttggtatttggtgttttgataagaattgcattacatctgtggataactttgggtagtatggacattttaacaatatcaattcttctaatctataaatatgtgatatctttccatttacttgtgtcttcctctatttctttcctcagcgttttatagttttcagtgtagagatctatcacttccttagttaagtttattcctagacatcttaatttttggaaactattgtaaatggaattgttttcctgaattctttttcagatagttggcttctagcatacagaaatgctactgatttttttgtatgttgatttagtgtgctgtgacttcactgaattcatttattagttttaacagttttgttgtggaatctttagggttttctatacataaaatcatgtcatttgtaaatgggaatagtttgactttcttgtttccaaattgcatgccttttatttcttcctcttgactagttgctctggcaagcacattcagtattgtgttgtgggtttgtcatatgtggcctttcctgtgttgaggtacataccttttatacttaatttgtggagagtttttatcacgaagggtgttgaatattgccagaagctttttctccatttatttaaatgatcatatggtttttttcctcttactttttgttaatgtggttgtatggtttggatatggtttgtttgtccctaccaaaggtcatgttgaaattggatccccagtgtggcagcactggaaagtggggcctagtggtaggggtgttttggttatgggacagatctctcatgaatgacttggttctattctcagtgagttctcactctctcaggagtggactggttcttgcagaaatggataagttccagtgagagtgggttgtcataatgccaggatgcccctcaggattccctctctttacacacatatgctcttcctttgactttccctgccatgttgtgacgcagcaaaagcccttgcaaaagccaagcatgcttttgaacttctcagcttgcagaactatgagctaaataaaccttttttctttataaattacccagtctctggtattctcttattacaacaccaaataaactaagacagtggtgtgtcacatttgttgatttgcatatgttgaaccattcttgcatctctgggataaattccacttgaacacagtaattgatctttttaatatgctactatattctgtttgctagtttcatgttgagaatttttatgtctatgtttatcaggaatattggactttagttttctttttttgttgtgtccttgtgtggctttggaatcagggtaatgctgcctcataaaattagtttggaagtatttcctagtcttctattttctggaatagtgtgacaagcatcagtattgttctttaaatgtttgatagaattcagcagtgaagccatcaggctgggctttgtattttattttttgatggagggtattttattactgattcaatttcctcactcatcattgatctgtccaaattttcagtttcttcataatttaatcttacaatccttcgtatttctgtgatgtcagttgtagtgtcaccttgttcatctctgacttgaagttttgggatcttatcatattttttcatagactagctaaatgtttgtttattttatctttaaaaaaaccaactcttttgttgttttttttaattttttagtctctgtttatttctgctctgagctttattatttcctttcttctaccaattctggcttagtttcttcttgtttgtctattttcttgaggtgtttggttaagttatttatcaggaatcttccttattttttgatgtaggcatttattgctatgaactttcctcttagaactgtttttgctgtgttccataagttttggtatgatgtgtttccattctcatttgtctcaaggaatttttaaatttccctttcgtctacttacccagttggttactttggagcatgttatttaatttccatgtatttgtaagatttccaaagtttttctcgttgttgatttctaggtttgtaccattatggtctgaaaagatacttgatatgatctctatgttcttaaatttttaagtcttgttttgtagactgcagtatcatttatcctggatgttctattttcagttgagaagaatgtgcattctgtagctgttggatggaatgttttgtaaatacctgttaggttcatttagtctgtagtgtagtttaatatgatgtttctttgttgattttctgtctgtatgatctgttcattgttgacagtggagtgttaaagtccgatactattattgtattgctgtctatctctccctttagaactaataatacgtactttatatatctgagtgctccaagctggctgtgcaaccatggatgggcatgcatatgctggaaagctgcacagtgcctttctccagtaatgtagggctgacttcaagccagctgttgtgctggaaatgggtatgtgcaggccaagaggcctttctgatgtcaaattctttgagttatttttttaaaatgttacaatatgccttggagattatagatatacatacatacatgtatgtgtgtatacatatattatacatttccttcttttttctattgtttgcttttgatgagcatatgcttttcctgtttgcttttgtttggtttggcttaaactttttaaaataggtttttataattggcaattaaaaatatacttttttgctattaatgagtatatatgtctttcgtataaatgcaagcttttttacacaaaagatttctagaagtgagcttgctatgtcagaggatatttgcattttatattttgatagctacactctgacagatagcttcaaaaagaactgtgcttagataacatctgagcttgctcttttcaccacattttcaaaaatagtatcaacctttttcttatattctcaatctaatgagcaaaaagttactgtcttcttattttaatttttattccctctgctagtgagttaacaaacaaacacagcatatgtctcttagttcgtgtatattttctcttgtaaatggtcctttgttcagatttctattagcttgtctttatatttttttgaaagagctctgtataaaatgaatattaaacctttgtatattatagatgttatgactgtttcctcctagttatcttttaactttgttcactgtagctttttccacatggaaattaaaatatatgtatagtaaaatctttcagtcttataaaaattttttctaagtccttttatcattttctttttaaatttgatatctggtgagacagattccaattaattatggcataatttaaaaatttctttgggattcttgcctattttattgttccatataaaccaacaaattatctgtttaaattgattaataatcattaggattttgattgaaattttatctatagatttatatagaatcaatacattaaaatatggactctccccacccaagaacacaatatattgttttatatgttcaaggctttttgaatgtcttatcatacaattttttcatttttaatatagatcttacacatttttggtacctctatgtttatgtgttttaatgtcttattgttctagtcaatatgactttttaagtataattttaatgttttatttttgtcatatagtcaagctgatttttaaaattttatctaacttttatatagtttttcataaacttgtcaattttttatagattttatttattcttgcagagtcgccttttgctgtgattaatcaagccaaccttgattaattaaaccttttaaatttaaaccttttaaaggcttactgtaaattattgctgtgtttattttccacccttattaattatttccttcaactttgttttactttctttgttgtttattaagttgattatttaattattttcaacatttttgctattaattggtacatttttaaggctacttatttttcctttgagtttatctttgcagtagcctattttagtatatattcacagcgactcagtgattttaattttgaattcctcttacagtcaagatttattaaaattgagattttaaatgtatgcaattggagagttttcttgtcgttctttgtttttgcaggaaggaggtgttcatttttactatttatttatttagccagaaagtgtggaccataatttctactgttacaaatgtgtaaaattattttgtggccttatgtagtcaatcttttaaaatattctgtaactattaaaaataagtcatttttgtttgttggatataacttttaatattgaataatctatattgctgtttatttctgactacttcatatcattgatttataatttgtgtccaaatacaacagtgaacttgtttatttctccttataaaattttaataagttgaccttatatttttgatgcatgttgctaagtacctatgatgtattatcttaatattttttaattattttcatcttatactcaagtatatttatgattgataggaccagtcttgatttattagtgaatcttcatgttcgaccattctatgtcattttcatgtaattatgattctagtaaagagaatgtagctaaaattattatgtatatctgacatggcttctatttttaatgaggagttttacttaattcacatttgttgtaatgatcgaaatatttaatcatgtataacctgcttgtttatttttcttcttcttttgtattaagcttattttattagggtattttttcttcattctttctttagtaattctgcattccatttttctcacatcgtgtttgtttaaatacagtatgtaaacttacaatttccaattctatgttgacattaagtatgtcctaaaattgctctttctgaattagattctcagtaatttttcattttctttctacttccctgccccttcctgtgttttgttaaaatgatcatcaacatatatattcagcttatttgttctttaaagccattttcttaggaattatttcctggaaattgccctttaaagtgtcatttagtgggggcgcagtggctcatgcctgtaatcccagcactttgggaggccaaggcgggcggattactggaggtcagaagttcaagaccagcctgaccaacatggtgaaaccctgtctctactaaaaatacaaaaaaattagccaagcattgtgatgcacgcctatagcctagctactcaggaggctaaggcaggagaatcacttgaacccggaaggcagaggttgcagtgagccaagatcgtgccacgaaactctgtctggaaaaaaataaaataaaatgtatcacttagctttattatcaatactttttagacttaaaaacatgcattctggttaaattgttgaccgtctttccttgtatctcacagtgtcatctttttttagatttttttttgtttttcctcaaatatatcctcaaatattttcttcaaaagactcctattagataaagcttcctgagaccctgtgactgaaaatgttacctcagccttcacacattaaagataatttcaatgtaaaattctaggttaaaaattatgttttctcagaattttgaagacatgcttctacagtctctttgcatccacattttctgatgaagataatggtatcaatcagttccttgtttctttgcaaggaattattcactgcactgtccaaaacacagccacctagcacatatgtctcttgaacctttctttgaaatgtgagtagtagactgacgaactgaattttaaaatttcttaaattttaattaatttaaacttaaatgtaaatagccatgtgtagctagtgattagtgcagctctacatcacgaagatacgtatagttggttcattaatctttgtggatatgcagtatgggcattctccatgagttaattcatttttcatacttttcaaccctttgtcatctgtactcttttctaggagaatccctcattttaatcttctattttattattctagtttcaactattctgctgatttattaagtttatggtaattgtgcttttaatttccaaggattctgcccattaattttttatagcagccagttgcttttatcataaatatttatgaaaattttaaaaagtgtataaatatatataaatatatacatgcatgcatgcacacacactgtatgtatattttcatatatatttatacactttaaaaattatatatttttacacttatatacactgaagtgtatatatttttaaatatacactttaaaaaattaaatacatatttccattttatttctgtttcctctatattaactctcattttcttagtggttacctttttgcttgttgagtcagtgactcttttttcatactgtgattctatcaaatgtttagtaattgattatgtcttgatggaaaagtattgatagtgtcatcttatttactcagcacaaatgagaagtaatggtaaatacaggtactagtaacaggagccttcgttctatgtactagacaagggaagagagacacataaagggcccctctataaggataggtcatagcctcttgtattggcacaggagaccataagttatcagaggtacttctcagaattcccattttataaagctgtatttacagcataatcctagaagcaaacattgaggtcagctgctctgaggacagggaattggcatagtatacacacacataccatacacacacatacacacatacacacacacacacaataataaacatactggtccaaccacccatagttttctacttctagccttcactactacttctgatcttgtgcttatttgtggttcatctggaaaaaattacttactttggaggctcttttatctgcatggcttatagatttcagagacctggctaagttttttttttaattggttgcattgagatttagaattggtatatatcgtcctggtggacggacaccttatcactgtgatatgaccttgtttattccaagtaatgctttctgtttgactaatatcaatatagccataccagttttatttggtttgtaactacatggtacacagtaccactctactgttgtacacacatataaattttaaaaattagcttgaaaatattaatcttctacttgaattattttgtttgttaatgtacttattgatgtatttggatttatatccaccttattattatttagcctacctgatcttttttaaatgcctttggtttttctttcttttagattaatcaggtgatttgtcattcaatagtttattatcttattatttttacattttaaacaattcttttaatgcctaagagataaaaatatgtacccatgtcttattacagcttaattcaaatgattgctttcacctcttccacaataaggatacaaccttataacactttaacttcatttatccctttggtattattgtcatgtattttaattttatatatattttaaattccccaaacataaacattgttattttgtgccatatatatacagacatatatatatatatacacacacacacgcgcgtacatacatgcatatacacacacacacacaaacacacatggagaggaaaagaaggtgggagaaagggagggagattgatagagagcctcactatgttgctaagtgggcaactgagcttatctcaaaacttctgggctcaagcaaaccccctgccttagcttcttgaatagctgggattacagttgtgagccatggcacctggcttatattcacttatgtttacccaagtatttatctttgtattgctcttcattttttccttcatttctgcattttcctttatgattgattatgttatttatgaagaagaagttgacttaatatttcctttagtacagtcctaccaagaggaattgttttgatttttgtttttctggaaatattagtatttcatatttatttttgagatatattttcattgagtgtacaatgctagttgacatttatttttagcatttaaaaaatattccaggccaggcgtggtggctcacacctgtaatcctagcactttgggaggccgaggcaggtggattgcctgagctcaggagttcgagaccagcctgggcaacacggtgaaaccccgtctctactaaaatacaaaaaattagctggatgtggtggcatgcacctgtagtcccagctactcgggaggctgaggcaagagaattgcttgaactcaggaactcaggaggtggaggttgcagtgagctgggatcccaccactgcactccagcctgggtgcctgggtgacagagtgagactccatttctaaaaaaaaaaaaaaaaaacaccattctaatttcttctggcttatatcatttctactgagaagtcagctgtaatcttatttctgctccttcaaagatactgtgtattttttccttttgcttcttttatgatttattttacttctgtattttttaaaaatcagtttttctatgatatgccttaatggtttaaaaagtgtttattatgcttttagtttgctgatttttttgaatttatggattgatacttttcttcaatttggaaattttttttgccattatctcttcaaatatagtttctttccaattattttctctctttctgatatacaagttacatatatgtgatgcaatttctctttctctctattcttgcctcctccctttctttttctttctgtgtttccacttgggtcttttctattgactgtctttgagttcattaatcttgtcctcaactctgtccagcttggtactgtatgtatccatttagttcttattttaagacataacactttttatttctagaaatcccatctcattattttgtatagattctatggtggctttatattatgccaactaggttaggctgatctacatttctcacagttctttttcttccatgtttccaattgaagtgggtcatgaaagacatttcatgtgaaattcggaaggtggaattaaagcggtgatcagattaatttacacctggaaagtcatgaacagactcaaatgctgttgcagctcacacatgctgtcattgatctgttggttcacatcattggtgttgagcagcagacaggccttcagctactcctctttcagcttctcggaatcgttagccaaaggtgtgccaactgtatgacaaaggcttttaacttcttgtgcgcaaccattcccactgatggtagaagtagtgagaaactggaaggagcctaggtccatccccatgtgttccagtttattcctgtggattccagtttattctcactgacccaaccttgatatctgttctttttcctcaaatgtttaaccttgagacatgaacctccagtatcagatacaaaggcgtcaaccttaatgtgacttctaaccaactagatagaacatgactggttcagattttaattatctgataaaattctccaacattttatctttttgctgtataatttatctatttttcttattcatgttattcattttttttataatgtttgtcttaatatctacatcatgtgtggatttgtttctgttgcctatttctttttctcttgggttttggacccatggccctgtctcttgccatgcccaaaaggattttaataaatgcagaacactgagaataaagactacagaggctccagatgttgtgatcttgcattagaaaagggttaccctttcttctgccaggcagatagagaggctatcaccttaatttatccaggaataggctgactttagacatgctagaagttttgattaagattcagtctatctttggtttcctttgtctgtagtctggagatctctgtggcttgcaattaagacactacttcattcactagctcattcatcctagcaagtttttgtattctcagcactgggagagtacaaaatgtcccactccaccactcagggtttgtagcttagctctttagctccaccctgcacaccttcaatatttggcaaatattttgaggggaaaatcagttgtgtcttgagcctcttcaattctccaattttttgactccaatccttgtaaatgccaaaatgtctaatggtttctgtgtccccaacggtgcccccttgccatttgaaagcctactttcccagtctacccatgtcaagaatcagcacaatcttccagaaaaaaatgcagctgaagatcattattacacctgtccaatagccttcctttccaatgattttagcctctctaatacttattatctacaactatctattgcatacctttaaacagatgatttttgtgtttgttttgttttaaaaaaatcaacaggtaaatcaatctacttaaaactaatcttcatgcaacaaaaagcctgccaatctgttcttatttatatcaaactgaaatttctattagtttactgctctgctcttaggataaccagttccctagtcttaccatggcttttacaatcatattataatgtcttgtcagtagtaatttgagagggaagataggtgaacatgtcccttcaataagccatcttgaactagaacccccagggcattttgaaccttctgcctgtattacagttatctgattatatttgtctctactgctatgttatacatttcttaaaggtaaagactatatatgttatagttatctgattatatctgtctctactactatgatatacatttcttaaaggtaaagactttatgttattcatattcatgcttaccataatacttagcatatgtaatcatatatagtaggtattcatcatttatttattaaagaacttgtgaatagataactgcatgaagttcagagtcagtggctttcttggtatctttcacatgatgaatagtattgcttttaacaatccaaatattgtgtataatattatagaaatagaggcaaatatttcagttttttttttttttttacagaacgtggtatattctatgcccctaacaaaactcaagcaatattaaaaacaatttgcatctagcttctgggatttttgagagaattctttaaaaatgaaggactttaatcatctggtccctctagattttatagtagttgaagaaatatataaaaaaattttgtgatatatattttggttatctcctaacatttatatttccctttagaaaagaaaaaaatcccacatgaaaagggaaattgaagagaaatattacctaccacataaaaagtcatacttttgtaagattatatttccatttctacataatattctctcattatgaaatcatcagtgcattttttagtcataaacaagacagtgaaaagaaaatgagtaacaatataaatgactttctggaaaatgaggtctattcaaatttcaggaaaaaagttaactctgaagtattaattgatcataatgaggaggccaaacttcagatacacagaggagccatggaacatttcccataggcctgcagcttgtgaagacgtctaggaacactgacatgaagttaaatttaaaagtaaataaaaatagataagactatcagactgtcaacttgaagaacttcaacaaggaatgctatgctctggctttttgcaattcaaatatacagtaggaagaaacataatcccactaaaaaatacaattgccgtcattcttggccactagaaagaaatttcaaaaaggtcagcctctgctcctttcttccctaagaagtgaatcgatgatatagattatctcatgagcccatgaacagatgcccagttgttttggcagaatttcaaccctcgggagagaatcttaatctagtatctttctcactactggtacaagaggcaccaccactttctacaaacttcccaaccctgtttaatcttcacattctggtcttctcctttgacattccacctgaatattacatttttcattaaacaactatatatatgtgtgtgtatatgtatatatatatgtgtatatatgtgtatgtgtgtttgtgtgtgtgtgtgtgtgtgtatatatatatatatatatatatatatatatatatatgaccgttttgcagggactaagacaactcattcagtacagctcctccaaacaccaaatttttattaccaaatgcttcagatggacacctctttaatatgtacctgtcttaaaaatggaagcagactctcaagttccaaacttaagagcaaataccaaaaacaatgacaaactcagtggctgtgcaatacactgaccattcagaaagagaggcttgatctttcttcatcttacattgtcttctgaattcactaccattagattttggaagagcataaatttagaagaatgaagactcaccttccctacttcctttgcctatctctccaggacgacgatagaattttcccttctctctgacacttatcctgactatataatatgcaacactcccagatcttctcaatggactagtgaccacatcacttccattcctagcaccatttatcaaacagtgacctatggaatcaaagtttagcaaaattttttagaacctggcttaagaaaaccaaatcccttgtggttacaacttcaagttgtttcatgcccagagaatgagctacagtcctttccagatattcatgcctgaagctcattaataattttcttctctcagtaagtgaagacgaatcctttaatttgaagtggccttcacactaatgagtcatgtcataactctggaatcctttaagttgattttttatcttgttgactcagtgaggtagaaattaaggacagctcccattagctttatgtatttcttgaagcatctgctcatgatggcaaactgatccatcctaaatatttatttgcctataaatgccatggagtcaacacttcactttcagctactttctttctttcttttctaacccaaacataaaatttctttaaaagttctgtcaataacatcacttgcaatttaaacgctttaaaaatatgatcctttttgctgtgtttttgaatacttccttcatatttaattgctgtagacactttagttcctaattaaactgtattgtttatgatgttcggtctttaatagacatgataacaaaaaaagccagttgtagaaaattctctgattgttaattccagtcttaatcttaatactttccatagccagtgaactcatggggttgagaggagaatgggtagaaaatgagatacaaagcaaatacatagttcatgtttttgaggatttactagatgttctggaagacaagcttgaattagacttgaattgaattgaactctatgatttgtaggggagattagcttagaaatagtatctcaaccacttgcaagataaatatcctcctttgtcaagtctcttttcagcacatccccaggtttcgcgttggtgacagagaggagcatatattgcacacagaaagcttgcttcatcctcagagccctaaaatacttttattgtgagagaatggagacacttgatgaatctgatgggttctggtcatggaaagatttgctatgaaccattgcatcaaggttgaaatgcccaagaggctgacaagcttattgtccatttcaaagattaaatagttttggaaaaattttctcccctggcagttgtaattgtgtccatgaaataagtgttcattctgcttgagccctgtggtttgaatgcttccttctatatttccctccagtggattgattcaaaaaaagatttacttttttagacaatgcaaattaaccctgtgaacctgataacacctcccccaagtcctaacatccttgctgtgtcccatgctaataggcaatcagagacactgtcaagtctctttatcatggattatctttgtatctgtttgaagggagggaaaggaactgagaaatcattcttctaggttaataatgtggttctaggaaatggacaaaagctgccattaataaccttgagagccttgtgctgccagaatagcactcatgagttggtaaagtggccatttagttgtgggacttccaagacacctgaaaaggccttgattgtcccacataaactatagggaggataacgtctccaaaagaagaaagagggtatcagcagaaaaataaaatacaggctcatcataaagcaatcaactgttccctgactttgcccagggtcaacattacatattagtatgctacgtgctgacaaatatttgaccttttgagtgacttacagcatttctgtttctaacctggttaggtaaagatcattatgtgttaacacagaccacaacatattcctacttcacaggtaattatatctagaattcttaagtttatcattttacaatagcctcaatatcatgccttaaaattgaatgtgagaatatcaaagaagcctggggacagttaatggtatttacttctgagcattcactatgtccctggcactgggctaagcctgtgagtaattattttgtgtaatcctgtaacaattctatgaggtaggctctggggctatcctgtagaaactgacactgacactcagagagattgagacgcttgcctaaggtcacacagttagtaattcactgcatcagtttgaacccaggtcttcttcgggatcctggaattggagctcattcataactattgtcctgtactaccttcctgtactatctcaatcctcagtgtcctgagatagaaggataagctaatgctagaaagaagattctttactaaccagacgcatacatagtatgtcgactcttgttggatatgatttttgtgtcattctattattaataagaatagcttctaactgtttttgaaaatgtcgtttgtggctcgaaagcatcttaggatagtgtttgttgcccttgttcaggtactgttctctctccacatttttgggtcttcagaatgatcagcatccatgcctgaagtgaggcaatggtggtccacatatacgagtgagaaaacaacgagcaagaatatctttgttcaggtggctggcaaaatcagctcaccatagttctctagaaactatgagccaaataacaaggcaacattaaggaagctattaatatattgaacatgactgaagccatactagatattagcatcaagcagattcttttctgtgaaaagtagaaatagcagtgggaaacaggacttggaatataagtatgccaatatcatgaacactgacaactagaagcactttttaattaatggaaatgaccattgctgatatcccaagtgatctgtgtgcaggcatcacctgttgaagatgaagatgaaggctgattggtgttttcttacatttccaccagtcagaagtgaataataattgttatatgaatattgtatgctgaaattcatgtgttgaagacaaacctccgcagagccagaggattttctttcaccttcactgcccacaagtctctgtcattcttggctgcacgtgtttccttgcttgatttatctaattattttcttccttctttagtcgaccaagtatttagataccagatggtagggagatcagaagcaggaaccttttctgtctcacatggatgttgtagggattaatgaactaacatattctaaaatgattttaaaaggtgaagtgctatataagtgtcaagcatgattaactagcagccaagttattaggcacctgaatattatgcatcttttctgaatttcagaaaaatggatgtacatattaattttcaacagcactgttatttgaatgatattcatacactcaaataaaagtttagcccaatcccaattatctctacttttctcataccagtcatgtaggccttaaggatggaatatgtatgcaactttgagtaatacagacacaattaccaatcttgtggcgtttttagtgcctcaaggaaaagatacacagtaaaatgcaaaatattacaggaagattgagggacagcaatgagtatgaactgtagctcagaccctctggttccaaactctggtttaaccactagttctgtgactttgggcaaattgttttacctctctttgcattagttatttatgcaaacattggggtggatgatagtacctacttcatagctcatacatataaaatgctcacaaaagcagttcctcacatgcagtgattgctccttaaatattaactattatcattataattgtcactaacactggccttggctggtttcaccctctgagagcgttaataaataagatgtgtagttacttggctaggattcatgtataacttttagtagtttacaaagcccagttacttataatcctaacctatgattattcaacacttgcttgtgccagaatccacaaacctcggtgaaataggttagcaaaatggtagcttttatttttgccttatttgctcagcaaggtttttatttccgttcttctggtaatacactctaaccactaccttttatcccaggtacaggggcggacaaaacttcatacctgattaatcgtagtacttcttaacctaaggcaaacatgtaaaccagcagggctgacctgaggccccctctgacatactaagtaaggatttgatttgaaataaataaaaatagccttgcctaggggttcattatacttgaaaaatgtgagattggggttaaaactgaccacgttcattgccacatgaagaaagtccagctatagtaaaaaagaatgaagccgaacagagctgagctgagctgagagatggaaaagggagagagttctcttagctttgagttttgatcctagcaattgagaccttgatccctatcctttgatttggtcagatagcacagtatcccttccagccatgtgagccaataaatgttttctttttgtttactttaaaatagtttgaactgggtttctgtctcttgaaacttaaaggatccttacaaaacaaatgctataattcacccatttcgtggataagggaattgaggcttagagagattaagtgacttgctcatggtaacataaccagtgatttttcagagccagaacttcataccctatttaatgactccaaatgctatattctagtcaagacaacaaggccagggagctgggagatggagctggtcattaatgaaaggggcagagaagttatagggcaccatcaaattgtggctatcctcgtagctaattcatgcactggttcatcacatatttgttctaaatatgtgatgcacaaagaaaagaaaatctaaggccagttgtttagatagagaaagtgagtgatctgcaggtaccctcaaccctcaagggtggctgtctgctgtcagctgctgttacccagcaaggggtgagaagccacagagccagcctactcgtgtctccaagttgctattccagtgaatgcaatgtatgcagaacatgtcaaactcttgggccgctcagaaaattgattatggagcttgccccttccttaaaaagcaggcttttgtttttattagcatgtgtaaatatggaataacttctaaatgcaaatatggatgacatttgatttttctgacatgtttggaagcagcctggggcaaggtggcagtgaatcagtaaacatcacgggaactacactgggaatgtatcaactgtgcatactattaatgggtttatgccatatgttccataataacatgtttgctaacatgggattggactgcctggttgtatgacaaagctgccacgtcagttttctgatgtatagaaactgagtctgttagccagatatagaaatctagcaaggtcattttaggagtaatttccattttgtgtgcttttttccccctcattgactgtaagagaatgtgatttgcctcattacaatacaattccaggtacaaaatacaataatgacctttatgccaaagactgaagttcatgtaattgataaaatagactcagttctgcagtgttggaaaccattagctggaggcaggaaccgtgttaacttcatgacgtgggaggtcaaaggtcaaggtaaaggcccaggctgcaccacttctggactcagaaagaggaaaacagggctgcccagcaacattggagtttgcggcgctccctaggtgtgtcagagacatcctggggcatgtggaaagtgaaggaaaggcctgttattaaggtgagggtcaaaaagaaactagccaaacacagctgcacagtaacagactggaacaatgggccttatgaagcagggatactgggatagctgtcgctccatttgtcttctctttactgacttcatctgcttcatatctgaccccaaattatactgcccatttggaggcattgcttctttttcctctcctggattcttgattgttggtgctctggtgagaaaccagaaatgtcttatgaaatctttatagctacgtaggaaacttgagcctgccattttcacccacccagggaaggtatttgcctcccgaaaccgtagggtggcctgacatctgctttttattgaaagtagccaaacaaatcacgtccaccatgtggtgattatgacaagtgtattgattgacattttatgaaacatgcatttacaaatggcatctgaataccgaatgccactacggaccttaggactcttcctcaggcagcttggtcggagtgagatattgccagcattcattctccccttcactctgattccactctgattgagagtgcattgtttaatatcccctacgaacgacaacaacccaaacgtaacatagaaatcgggagtgaaaagggactgtgaagagtcacatactatatgaaacttgcagcttataaagagagaattaagaaagaaccagaaatgtatatatttggtcagaaggaaagagaagtgtgaacttaagggtattaagcagaggaaactgcctaaaatgataaataaaatggttagttcagttgtttctttacatccctggagttataagtatctccatctgaccatgagttaatggtattgggtatatttactgttgtatgattttcagagcttctagcccaaaactggagacaaaagctctatgttctaccaatgctcacagatgaataatgctttttttaaaaatatcaccaattctgctgtcatttcagacctcagagactctgcttattaggataggaggcaagcaaagaaatgaggtgggcatagaggtggcaggggttaatttcatatttatcatgagatcttgcatgatttccctaaaagatatttaatttccactgggcataataacttgcagctgccagaatgtgctgtgtaccagtggcgagttcttgtctttggagacttatgcaagtcattatttaaaaatagagatccgggagttacagctggctaattaatctaccactaaggaaagctaagcgagtgacccacttaactgctttcaggaaccatggctactctgaagcaaacttttgaaaaagtcctgtacaaagaaccaaactgatacatcctcatggcactgtcgtggtcttctcagggaacatgttccttctccatctgctcctcattcccacaaacaaacaccactaattcagacccttatccatacacatgtgaacgtccacagtgtgggttcccagatactttgccttttgggtccttctttctgaggttgctgccagtctcttattcttctctttttcctacatcacccgcctgctcaggaaccccgcttcagtccatgttccctattacttccactctgaggcttctgcctgtcttctgaggattcccctaagagactcacaccacatagttacccatatttcttccattccctccactgcacctttccctccaggcagaacaggtctctgccctctcatcctgtccccttacccagaccacctttcccattcctctctcagcctgaatatggtccgtacatcctgcaaagctctactgtatctatcccaggatatttttccttggacttgatagcagatggttgacataatcaaatcatgacacattttcatcattggtctgtgaggaccctaaccttattcttcagtaagtctattgatatatttattatttttcttcctactcctttccccctccctgcagaggcaggcattctattatattttatatacaccttttttattgcacacacccttgtcaaaaaattattgtcatacgtatatgtattttaatttccataaatgacatgtgttaaatttcatctgttttttactttatttacccagtcctatatcttttttcttttttttgagacagagtctcactctgttgcccaggctggagtgcagtgccgtgatcttgactcactgcaacctccacctcctgggttcgagtgatcctcctgcctcagcctcctgagtagctgggactacaggcacccaccaccactgccggctaatttttgtatttttagtagagacagggttttaccatgttggccagactggtctcaaactcctgacttcaagtgatccacccgcctcaacctcccaaagtgctgggataacaggcttgaaccaccatgcctggcccagtcctatacctttaaagtccatccatgtctctaatactccatggtaggcaaccaccacctttaactcttcgctgtcttcataatgtacacatcgagatccctctcaccccctgtaactccccttctctaaaatcccctggccttcatttactataaactagactcttaattatatgctgttttgtattttcctaggaagggtttatgtttctcccttgtctctcatgtaattcctttgagatcagagaccacctcctatactctttcctttcctactccacccaacactacttctgtagatgttctttggagctctgtgcataattgatattcaataaatcattgtttattcagtgaactgaatagtgtaactccatgaaggtaggtatttttctttgttcataaccatatctccagtgtctaaattgtacatggcatgtcataggtgatcaggtaataggcttgaagaaaatgattgtctcacctttcacataagaaagggttatggaataatagattatacaggggtcaggatacctatgttctagtttctagtttgctgccaactagattgtgtgacactgagcacatcaggtatcttctctggatcttggtttgactgaattatttctcatatccttttccaatctaacttgctaagactgattttattaacaatttttcaacatgaaataaaataatcttcaatgtaaaatcatctctagagatagaataatcatactcaaggcagtagggcatgggatacacagggttagggaaagagatgagaaaacatcctatggttccaatctttcgctttcagaatgattggtacaacaaaatgaactactacctgtaaagagcttagaaaagttcctggcacacaataagtcctaaatagtgtctactattatttttataaacttaagaaattctactagcctttatgataatattttacctggcatttggaagttatcacagttataaaccaaacaataccaggaattctagtatcactactgaaattaataggtttctttgatgggacagtaatcacaagacacattctgatttctttaagtataaatatttttttccccaggtaatggacaagttctaattctcatggtttttataaggtgaagtaaaggaatattgtccttcaagatcagttagcagccaagaatgatatttgggccagaatcctgagttctatatttgcaatctattttaaaaaatgactatttctactatagagcagtcacttaaaaatggaaacagaatagagctgtgaatttattaatatcatatgaggatgctatttttccctttggtaaggaagtagtaactaaataacctaatctagtttctcttatcctcagggaagtgaatccaaatattggataaaccattattaaaattctaaacagcatttaaagcatgagcttgtttgttgctataaggctattttttttttctctaggtcgagaggtaaagttatttgtcttaaagaaaaaatcattaaatggtattggtaatgggctgcaggttttataacttaactatatttgcttcacgagcaaaaatagcatttgatggctattttattctactcttcttgggcaaaagaaatcttaatcaaacatcatttcagtttaatgcttttacatgcaaaattcaatttgtgaatttatctgctatctaaatgttaagataaaataagatagaaatacaaaataaggactggagactccatataagctagaaatttttggacaaaggaaggattacaacttctactcaaagggtttgagaaacaggtagataaaatatctagttaccaataacgacctaggaaaatgatcacaattcagttgttttagagctcacaaacactggagtaaattataatacttacatgatgtcttagtctgttctcacactgctatgaagaaatacctgaggctgggtaatttataaaggaaagagatttaattgactcacagttcagcatggctggggaggcctcaagaaacttacaatcatggtggaaggggaagcaaacatatccttcacatggtgtcaagaaggagaagtgcaaagcaaaagctccatataaaaccatcagatctcatgagaactcactcaacatcatgagaacagcatgttggaaacctcccccatgattcaatcatctccacattgtcactcccccaacatgtggtgaccacagttcgtattacaattcaagatgagatttgggtggggacacagagccagaccatatcacatggtgaaatggaaagcaaaaaaaaaaaaaaaaaaaaaagcaggggttgtaatcctagtctctgacaaaactgactttaaaccaacaaagatcaaaaaagacaaagaagagcattacataaaagggaacaattcaacaagaagagctaactattctaaatatatatgcacccaatagaggagcatccagattcataaaacaagttcttggagacctacaaagagacttagactcccacacactaaatagtgggagacttttacaccccactgtcaatattagacagatcaacgagtcagaaaattaacaaggatattcaggactcgaactcagctctggatcaagtggacccaataggtatctacagaactctccacgccaaattaacagactatacgttcttctcagtgccacatggcacttattctaaaatcaaccacataattggaagtaaaacactctgcaacaaatgcaaaaaaactgaaattgtaacaaacagtctctcagaccacagtgcaatcaaattagaactcaagaataagaaactcactcaaaaccacaaaattacatggaaatttgaatgactcctgattaaataaggaaattaagacagagataaataatttctttaaaaccaataaaaacaaagagacaatgtaccagaatctctgcgacatagctaaagcagtgttaagcgggaaatttatagtactaaatgcccatatcagaaagctaaaaagatctcaaattgacaccctaccatcacaattaaaagagctagagaggcaagagcaaactaaccctagcagaaaacaagaagtaactaagatcagagcagaattgaatgagatagagacatgaaaaaccctccaaaaatcaatgaatccaggagctgcttttttgaaaaaatgaacaaaatagaccattagataaactaataaagaggaaaagagagaagaatcaaataaataatgatacaatattgtgtaccatcattttacatttccatataaaagcgttaaacacaataagaaatgataaagaggatgtcaccactgatcccacagaaatgcaaactaccatcagaggatactataaatacctctgtgcaaattaactagaaaatacagtagaaaaggctaaattcctagacacatacaccctcccaagactaaaccaggaggaagtcaaatctctgaatagaccaattacaagttctgaaattggggcagtaattaatagcctaccaaccaaaaaaaagaccatgaccagatggattcacagccgaattctaccagaagtacaaagaggagctggtaccattccttctgaaactatcttaaacaattgaaaaggagggactcctccctaattcattttatgaagccagcatcatcctgataccaagacagggaagaagcacaacaaaaagagaaaatttcaggccaatatccgtgatgaacatcgacacaaaaatcctcaataaaatactggcaaaccgagtccagcagtacatcagaaaatttatctgctatgatcaagtcagcttcatccctgggatgcaagtctggttcaatgtacacaaatcgataaacgtaatccatcacataaacagaaccaaagacaaaaaccacattattatctcaatagatggagaaaaggtatttgataaaattcaacatgacttcatgttaaaaactctcaataaactaggtattgatggaacatatctcaaaataataagagctattcatgacaaacccacagccaatatcatattgaatgggcaaaaactggaagcattccttttgcaaaccagtacaagacaaggatgccctctctcaccactcctattcaacatagtactggaagttctggccagggcaatcaggcaacagaaggaaataaatcatattcaaataggaagagaggaaatcaaattatctctgtttgcagatgacatgattttatatttagaaaaccccatcatatcagccccaaaactctttaaactgataagcaatttcagcagtctgaggatacagaatcaatgtgcaaaaatcacatgcattccttacaccaacagtagacaaccagagtgccaaatcatgaatgaactcccattcacaatcactacaaagagagtacaatacctaggaatatagctaacacggtatgtgaaggacctcatcaaggagaactacaaaacactgctcaaggaaataagagaggacacaaacaaatggaaaaacattccctcctcatgggtaggaagaatcggtatcacaaaaaggccatactgcccaaagtaatttatagattcaatgctattcccattaaattaccattgatgttcttcatcgaatgagaaaatactactttaaatttcatgtggaatcaaagaagaccctacatagccaagacaatttcaagcaaaaagaacaaagctggaggcatcatgctacctgacctcaaactatactacaaggctaccataaccaaaacagcatggtactagaccaaaacagacatatagaccaagggaacagaacagagacctcagaaataacaccacacatctacaaccatctgatctttgacaaacctgacaaaaacaagcaatggggaaatgatctcctattcaataaatggtgctgggaaaactggctagccatatgcagaaaactgaaactggactccttcgttacactttattcaaaaattaactcaagatggattaaagacttaaatgtaaaaccccaaaccataaaaaccttagaagaaaacctaggcaataccattcaggacataggcatgggcaaagacttcatgataaaaatgccaaaagcaatggtaacaaaagccaaaattgacaaatgggatctaattaaactaaagagcttctgcacagcaaaagaaactattgtcagcgtgaacaggcaacctgcaccatgggagaaaatttttgcagtctacccatctgacaaaggtctaatatccagaatttactaggaacttaaatttgcaagaaaaaaaaaccccatcgaaaagtgggcaaaggatatgaacagacacttctcaaaagaagacatttatgcagccaacaaacaggaaaaaaatctccacatcaatgatcatcagagaaatgcaaatcaaaaccacaatgagataccatctcacatctgtcagaatggtgattattaaaaagtcaagaaacaatagatgttggtgaggctgaggagaaataagaatgcttttacactgttggtgggaatgcaaattagttcaaccactgtggaagacagtatggtgattcctcaaggatctagaaccagaaataccatttgacctaacaatcccattactgcgtatgtatccaaaggaatataaattattctgctgtaaagatgcatgcacatatatgtttactgcagcactatttataatagcaaagacatggaaccaacccaaatgtccatcagtgatagactggatagaaaaaatgtggtacatatacactatggaatactatgcagccataaaaaatactgagatcatttcctttgcagggacatggatgaagctggaagccttcatctccagcaaactaacacaggaacagaaaaccaaacaccacacgttctcactcataagtgggagttgaacaatgagaacatatggacacaaagaggggaacaacacacactagggcctgttggggagtggggggtgaggtgagggaacttagaggacggatcaatagggtcagcaaaccatcatgacacactatacctatgtaacaaggctgcatcttctgcacatgtatcccatttttattaaaagaaataaaaacaagcattaaaaatggaaatttgtttttaatcataaatttaattttggggagtaccatagtcttctattaagataaaaatgggctatattctaataatgttattctgtgttgtggggctatattatcacaatagttcttagctgaagctgccgttttttcttatatggtataaattgtgataaaataagcattttgaacacccatggagtgttgccattaattaaagaagataatatttagaaaggcaatttgaaaaatctcaagtcctatacacatttgcttctgttattattttattcaatacaaatcacaaaagtgcctattgtgtaccagaaactgctttaggcacttgaacatttatggagaaataataacactgacctttgcctttaaggatttcataatgttggggaaaccaatatgtaaacagagaatgccaatgtaatgtggtaagtgtgatgatagatacatgccaaggtgcttgggagcatagaaagggacccctaagtaagtttttagagtcagagagttcagaggaggttagagaaaatacaggaagggagtttcagaggaggaggtggcaagaatgtagccttcaggtgaaaaatagcatagtatattctgagcagtaaagagatcagcattcctagagcttaaaatattgagcagagaaagcagaagatgagtctctagaagtcggattacagaaggtctgtctattatgttaaaggttcagatttatctgcttggtgatgaaaagtaaggaaacaatggggtccctccgggggagtatggaacgtggatccaagggtcagagagaacagtgaagagggtattgctgaagtctaggggaaagagccttcagttattcatgtttccatgctgtttcttagaggctcagcccaagtatctgatctttcccgcatctatgcataagttttctcaagcagtgctggtgatctccacaccgcatcttcctcctaaaatatttactgattatctgcattcaagtatgttataaactattttaatttgagatataaatattagtcatgcagctaactgcacccacctttccaggagcatctgctttttgtgacagacactgtggctttcaagggccttgccttattacttattacttattgcaccccactattcaacctgtcttcctactgcactaatatgcaccctgtgctgcagtcatgcagaagtcttcactgttctagaaaatgaagcacatgctgtgtgtatcacatggctggagtaatcatttggacagtgaagattttctgaggtgtccccatcatctcgtcacacctgttgcagaatgccacaggcagctctgtgaggcacgtgctgctgcttctgaaatgatgcattcccactcaattacctcattcattacaagttttcagctacagattaggagtactattcaccccttctgtcttagcagaatgttaggaacatttgaatcagtggtactttttaaaaaaaattagattttactgctgtttgctgtttactattacaatcacagaagtaaaggctaagccattttcttctttaaaaaatagtgttttccaatatgttcaaacaatctccaaatgaatagaagaaaaaaatgcccacagaagtttcttagactcactgtcatatctggatactttaatctcagatgttctggctcttcccaggctgataggatggctgggctaataatacaaataccttaagggctctgttctctactgagtctggacctagaatgtgcagctttaggattaggggtactagttttagagtcaaactgattcccttcctgattaccacttacaaactgtgagatgtctttagggtggttggagggattaaatgtgatcatctgcactgctagtatatagtaagggctcaaaaaatgaagcctgctatggaattatgactattaataattcatgctctaatttaagaaattgcctggtttaactagcctcaggcagaggctgggactgctttctcatcaggcctcagctacatggctacaatatagagaggttccttttcagatatgcacacacacttgcttctctcatcactgatgatgcttgctctctctagtcaattaatatgatccacctctcagggtaatcatttccctaaggaccaaatgtgcttacattcagttgcacccattgtaatgcaattaatttttccaataatatccatctaatagataggtacattataaaggagagccataataataagctacctcctgtttgctcattttgaagagactcattacggacaatggtcctcaatgttaatgaagtgacacaatccaattagaagattgcagttacacatggtagtggtagaatgagaggaattgctacctaacaggtaatgtcactgtttgtgccttgtttttgccctctgtggggttgtttctgctttggtccagatctcactctgtccttgggcctactttgggattctgccatcttctgaatgctggtaaatgcctaagctgtaaacagcttgcttttctgcagaacagctcatgcctgaaaaagttgataatgatttcaaaatttcttttaattgagtttttaattacaacacagatagcaaatagccctatcacatgtaattttgacaaagataacaagcaatttcatattctttggagaatgacagtgtgggagcctacagttaagtaccgactgccttgtttttagacaggaatatctgacaaccactcactcagggaaggtcgggaactggaacatctggatctcaataaattgttcaatataacaatccaagtgctataacacaagctgctactgggaatgtaaatctgactggctggtttaggatcttgtctttctaattaatagaccacgtattatgaattgggatactgtagagccagttggtgtatgggcatgccttcaccttaaataaatatttttatcttcagatcttatcacatcagaaaaaaatatgcagataaattattccaaaatgcaaagcttaaatttgatatgggtgccgtgtttcttcattacttttcttttattggcatttacttaagagttctagagccatgcccagagttccagaactccagagctaaaattagacaaagaaacttctccatctcagagagcagagaactcgcccacattagctgatctactggcacctcccacagactcacaaaggccatttgcataactcccatgcctcctagtaacatccaaaggctcaagccgatgtatctttttcaaccacagagcagtaattatcagacttttgcatttcaaaaacctggaaaacaaaaattcttcttaattcaagtcctacagagtggtcaacttcttattttgctaagtaaagatcattaatttttttccttttcactcatttgttaattcagtgaatatttattgagcacatactatctgcagctactaaagtatgtctgggaatgcgatgaaaatcaaagctagatatagcccatgacctcaagcatcatatagtctagtgggggagatagtcatcattaattaattacatttatatatatatatatatatatgaaatttaaattgagctacgtactctacaggaaatagacatggttctctgcaagcatgtaatatcatatattaattttatatggaaagagagtatcagggaaatattccccttaaaattaatgcttccactgaacaaatctcagactatgcaggccatggtaaggattttgagcttcatgttaagagtaataaaaagtaactaaggaattttaagcaggattgatgtttttaaagaattcctctggatgctattggggaatggattggaagaaaagcaagagtggaaggagtgagatcaattgaaatgacatttcagtggcctagatatgacctgtgtgatggccatggtgcaagtaactagttggatttaaaacatatcttgaaactagaatttttgagactctgacaaatgaagagagaagagagaaagagagaagtatcaaggatgattctcatattcctggcaagagcaacttgccatttaatacaccatttactgagctctaaagaccaagaaaggagcaggttaggggaggaagggggaatcagaggttccttttggggcttgttaaatttaaggtgcctatgaaatatccaaggcaggaagatacaggtgtcagaagattagaggaggattctgacgctagatatacatttaggagttatcagcgtatcgatggtatttaaagctatgggagtcaataacatttcacaggaataagcatgatggaagttataatatttttgaggcctgatacagaaggagaaatcttcagagcatctttccatgaaagggatcacattttaacacccacaaagtagaaagaacataatatcaattctttaatttaaggacatttagctgcatgaaatcctctctccattgtccttatctttctcattttgctgcagatcagtgagaactttgttataaaacagcagtggcaaaccactaccgtagcgtttctgcaactgccttaggcaggaattacctcattttggtagcagaaagtcttgtccacatccagcctcgcctcacctcttagattttccaagcttaaaacacatctggagattctgaatcaatttaggacggactaaaagtcacaaagtagcacagatcctacattatgacatccgttctgtcctatcctacattgcaaaatctgtgtctatgcattttgtagcattcctaagtcaggggactacattgcaaattgtaatattgttagtcatatatagggtcaaaaacacacttgcataaatatcgcctcttcctgccaatcacagtactgtcattcgtcgtagtattctttcctactgaacctaatataagtttccagatcctcctgttacagtgtccaagacagtcctaatcaaccaggttgaatatgggaggtaatagtaataataaaaataattatattatacttatagctgttataattaataacattttttgtactttgtctcatgcactgcactaagtgttgtctatgcctcaccttatgtaaacattaactgcaacttagaagattgctaagagatgaagaaacttttttttttttttttgagacggagtttcactcttgttgcccaggctggagtgcaatggcgcactctcagctcaccacagcctccgcctctcaggttcaagtgattctcctgcctcagcctcccgagtagctgggattacaggcatgcccccccacatccagctaatttttttgtatttttagtagagacagggtttctccatgttggtcaggctggtcgcaaactcctgacctcaggtgatccacccgcctcagccttccaaagtgctgggatcactggcgtgagccaccgcacttggcagaagaaacgttttacagatgaaaaaactgaggttgaacaatgagcatcccaggtgtacatttcattattgtttctacattgtgttgtaattatatgaaaagtacagattgagactctgtactttccaatttggaatcttaacacctaacagtgcttggcacatttaaggcacgtattaaatgttgaattatggaaggccttacatacgctatagtgatagaagcttttcaaatggaagtggttatgtcctgcgtgatttggaccctcttacagcacctagcataatactcaataagtatttggaaggttgagtatatggatttaaaattggctggaaaaattccagtaaactcagaggttttggagtgatggtgctagtagtgggatcactactgaagaaggataaagaagatgaacctcctaatatgctcttgccacaactgtgggtctgactcttatttaagcattcttattcatgacctggatggaaaaaaaaggaagaagctgctcctttttagaattcactaatgattctaatttggaaagtatcttgagcagctcgggcaacagaaataaaatgcaaatgacctttgagacatgaggtatgtaggctgggaataataactttgtgagcatttgaaaaaggcaaggcagtgaatacacctggggaaagagaatccaaacacagagctgttctgggaagcagatgccagatctcagtgatgccaaagtaggcccaggaggcacagtggttggcaaattaaattcaggccagccatgcagtctggcaggatgaaagagaagtccaggttgaggctgcctgtgcagaagggcacggaataacagttcctctgtggacagttgtagctgagcagcacctggcaccacacgttgtgttcccaccacttcattactagggaagctcaggcaatttggaagtgcagagaatagcaataagagtgaatgaattcaagagcccgaggaaggatgcggatgaaagattaaaaggattggatagctgtagtttagctacagaaagctaagggaagagaaaggagaggcctggaaactaataataaatatccaagtctgttctaaaatagccaagaagaaacttgcagagtaaccattaaattaagatttttcaattgaaaatggacattttcttccaagccataggcttcttgcctaaaccagcactctgcctacgcaggtgcttagtaaatactatcttatggaataacttttgtttgccaaaagagtatatgatctgggaactagaccaaccgaaaacacattaaaaaatcagacaacccattccttagcgccccgtgaggacaggattaaaggaactggatttttgttgtgttgttcaagtcatactcttcaacaatgaagttacctcttcccattcagacaaataaagaacaaaatagaaacctttgtagcacagggaatgcctaagacacggttgactaggctctggttaaatcccagtattgcaatttactttatgtcaaagggaacaagcaaaatgctaatgcctaccctctcagacaaaccttcctaggcaatggagggggtgtagaaaagggtgtactttctggactaatggtgtacttggtggacttcacttttaaatgatcaaccacttgggaggcggaggggagtggatcacaaggtcaggaatttgagaccagcctggccaacatagtgaaaccccatctctactaaaaatacaaaaaagtagctgggtgcggtggcaggtgcctgtactctcagctacttgggaggctgaggcaggagaatcacttgaacctgggaggaggcagaggttgcagtgagccaggatcgcgccactgcactgcactccagccccagcgacaatgcgagattctgtctcaaaaaaaaaaaaaaaaaaatcaaccacaaatatccaagtagataagttagaggtaatttcttgttttatagaaggagtctctataaacagccagctccccttgctttgagccattctttgtttacagatcattaaccacacctttcttaacttagtgcctgggtaagaaaataaagtattcagcttcccagccaattgcaaagccttcatagtgccattgttaagctccaggctcagagggcttcctcaaacaagccagacctttgaaacatactgctcctccctctgctggtcttgtttatcctcccacttctctgccccattcttgctttcttcctggctggctccctctcattcttttcctctcaacttaaatgtcccctcttctaaaaggccaccctatgtgtgtttatctgcttgggatgattttggctgcaaataagaggaaactgtatcgatagtggcccaggccagtagatattaattcacttgcttgaagtccataagcacatagttcagctctggtaccatggctcagcaatgcagtcaaggaccaggcagccttctagctctctgcttcatctcataccattggcttccatctttattatttcaatatatatgcttcaccccagcatcacttccatgccccaggcaggatgacatagcaggagttaagggagcataaagtctttcttacgtgaggcgttgttgcttttttcaggaaggagaatagtccccagagactcctaactatctctgattgattagaactgtgtcacgtgcaagatagtctgaaatatcatgattagctttccaacctctatagtaaaggaaggcaagggccaggggtctgtggatatcttttaggcagccaaacttcagtgtctgccatggtatatgcctctccctctcctaccccccatttaccctcagtcatggttccatatttttttctcttcatggcatttaccatgatttgtagttgtacattttaatcccactgggatagatatcttccatagctggctctgccgccactgtatccccagcctttagtgccctgtgcctgatgaatagcaggtacttaataaacatggtttgatttgtagcttagctggctgctagatgaaaagagaagagaagttatttctgaagttatcacacaatcacaacatcctggaaaaacaggattctggttatcaaaatttgatttacacatacatcctttgtatttattataccatgtttcaaatataaagagatgtatatatgaaataaaataacgaacactcaaattcccaccattcagctctatcaaatttacagattttgccataggcccttgaggtctgttgatactgttatattttaagaaacaaaacatctcaaatccaattgatgtccccgtgtcccttccctgtccgtgctcctgtctttctgtctccagaaataaccattaccctgaatttgagtttaccagtctagtatgcatttttatactatgactatatatgtacatagtcatagcaattacagggcattattttgcaggttttcaagctgttatataaatattatattttgtataaaattatatagattatataaatactaaaaatattattacctttttggtctatttgtttaactacatttttgcatatagctatgtagtgttttgttgtataaatataccacaatttatttttccatttttctgttgataaacattttgattgtttacagtcttcccctgtaataggtaatgccacatacaattaacattcttttacatatttttttttgtcacacatgtgagggtttcttagtctaagatatatacctagaagtaaatttacagggggaaggaggtaggattgctctgattttctttgattcggccaaagtgttctacaaaacagttgtgccaactgatgcttccacaagcagtggatgagagaagctgtttcaggtttcagcagttggtatcatcagacagatctgtatcaatcttttagtgtgaaatggcatcacatcattttattttgtgtttccctgacaatgaggaaggtcgaagatctttaaataggtatcttggccaatcaagttttgttttataaaaatttgtgtccatttcccttttagagggaatgggttttgttttcttattgatttatacagtactttatatattctggatagcaattctttgttgttaacatgcattgcaaatgtctttttccacactgttgctaggcttttcatgttgtttatgatgttgctttattaatagcagtattcaattttaatatcatacaatttatcaacctattactttgtggtttgggctttttatgtctcatataagaaaaccttcttcatttccaaaattctaaagattctaccatatttacttataaaagctttacagtttggctttctacaagtagtccagctggaatcattgttatataatataatgggctctaattttattttattttttgctgcataggtaactagtcatctcagcagcattattgaatgcttcattttttggtcactgattgattgataccaagtttgcatgtatgtgtgtgtctctttttggattctgtattatgcttcagtgttctatttttttccccatgacagtactactccttgattattcctgtagctttagagatattattgcatagggttaggtgtaggggcttagtagccatgctgcttgagtttgaatcctaacaatgccactgcctagccatgggatcttgaaagagttccataatctctttgtgtaccagtttcttttttatctgtaaaatggtgacaataatcatatctaacttataatggataaaaagcttttgcctgttttttgttttgttttgttttttgagacggagttttgctcttgtcacccaggctggaatgcaatggagcgatctcagttcggttcactgcaacctctgcctcccgggttcaagcgattttcctgtcacagcctcccgagtagctgggattacagcacctgccaccacacccagctaatttaatttttgtagttttagtaaagacagggtttcaccacgtttgccagtctggtcttgaactcctgatctcaggtgatctgcacccccgccctgcctgcaccggcttgccaaagtgctaggattacaggtgtgagccactgtgcctggccttgcctggtattttaataaaccttaaaagttagcagttttagtcatagtgtgagtatcagcattattattactaattgtgatatctgataggtcaggtcacttctaccctttcttcttctccaaaatggtcttaaacattgttgaccttttgctctttcacatgaatttcaagatcagcttatagtgcttcatgacaaagttgattgaaaacacaaatgtcattgcattgacatatggattaatttgattctccttatccgtaaacttgacataactttgtttattcagctcttttatgccaattagaaagtaattttgtaatttattccacagaggcccacacatgtttcttagaattatttttagctgcattgcagtttgttgttgctattgtgaataagatttttttcatcttattaattattattattacagcttggattctggtgtcaatgccatgttcttttttattgatacataatatttgcacatatttattcagtccatgtgatattttgttgcattcatagcatgtgcaattattaagtcaaggtatttggagtatccatcacctagaatttttactatttctgtgtgttggtaacatttcaagtcctttcttctaggtgttttgaaatttacgatacatttttgtaaactatagtcatcatactctgctgtcatatattagagcttatttcttctatttcactgtatgcttgtattcattaaccaacctctcttcatacccctcccaacccccaccacacacacacttcacagcctctggtaactatcattccactctgtacctccatgaggtcaacattttcagttgcatgtcagctccactgttgggggcagtggggtcactgccaatggttcatgctttggccctggtgacagcagccaggagcagcagctgctgcaggtgggggaggtcaatgggtttccaagggtgtggatatgcagagactgttgcaccctagggcaagatgcagtgtagcggaggctgggctctaaaaatggcaccttgctgtagctagttaggacttggggtatgtgtgggacccaatgtgagctccctctctggagcaatgctgtcatgtggattccaggcagctccctatgttagtctcagggcccacaaagatcaagggactctctcacggctaggattgctggagtctgtggtgggaatgtggaccactgagggtctctcacttaccctttcccccacattggagagcttttgcaggctctgagctgctccctactgaattggatgcctcacttccctcttcctttgctttcctttcacttttctgctgaattccagtgtcctctcttagatgacttacttgaagtgtgattatctgttcactcttttggctcctctttgtggaggaggtgagtaccagatacctctagtcagccatcttgaagcccctcagcgttattattcttgaatgagttgttactgctctgtagaaattctgttgttacctttatgttgatcatgtatctggccaccttgctgaacactgactaatgtttatggtctgcagattcccatgaattatttatgtaaacaaaccatttatgctttaatatagctttgtttctgtctttctaatatgtgcctcatatttatttttatttttcttttcttaaaatgttgactaagaactcctaacagcattaaagaggagtattgatagcaggcatccttatcttattctaaccctaatggtaactttatgttgcattattaggtttgattcttgctatcggtttttggtagataatatttatcaagtttagaaagttaccttttatttctagtttacaaagatttttagacataaaagaatgttaaatttcatgaaatattttttggagtctcttgagtttatcatggattatctatttttaatttgttattattgggtagtactttaatagattttctaatgttgaaacatctttttatcctaggataataatacacattggtaatcaatagtgtttcaaagaaatacttgggtcttttcccaaaggacaaaaaacctgaaggtttcaagcaattactttgatttgattttacataagttgtttttagatctttgtaggtaccattcctttatctctgtcatcttttggcatttatttattttttaatatggagcatgtaaaacgtgtataatagtaacaaaagatatgaacagtgggagatgaggaaggtggaaatgttagctctacttattttggaccacaaaatgagggttgctagaatctcctctgaagtactggatttgaaaatcgatcagccaagaatttctggagtcactcaggcccgtgccatataattacattatttgctgaggaggttaatcaggctggccatttgtctaaagacctggtgacacctatatccaaaattattttcaaaacgagcccttaactgccccgcataactgggtcctgcttgtgagctgcaagggcttgacttcttaggagttgtcctgtgtggcactgatgatacctggtgatggaaaatgtgtctgctcttattcccttacagccactttgttttctctctatttttactcgtctttagtaattacatgatttttgagactaacatacatgtaaaaccttttgtagatctgatgctaagcaaagaaacgatgttctgctcaataagtagagtttccatcttacaaaattatttcagtgcaattgcttttggtggtaaaatgccaagcattgtagaaatatgattttgatggtggttgagcagtactgtttctgtctaattacactcacgtattcatacaattactgtgaaattactgtaccaaaagcagtatatacacatagtaataataatgcaatgttctgattggctggctttttaaaagatttcagaaattgattaaaacatttaatggttcttctttcaagtatttgtgaaccaaatttcttattccaattgaaaatatgttacaaagagaatattcatttctccttcccccttcatcatgtagaacatagggagaaagatacggaactcctgggagttatctccttgattaactatgaagtaataaacagaagaaaacagcaacaattcatgtagttgggtactaaatctacacctttatggcctgcatttgccaactgtctccatatttgacagataaagtgcatctgtgaattttaagtctctcgggttatagttaagatatgtaattagagttccagatatacatcttacctaaaaacttctgctatggggaggggagaaaccaattaagtcagttttactcagcttcaaaaaaaacccctcaacctgaaaactgatgaaataactaatgaggacacttcatgtggggcatgttatttcttgatagagcaagtgtgttctgggacagaggctcttctttccctgaaggctggagtcaggaggtttacttggttaataaaaccacctccttgagacatgtgacttgatgtgtgtgtggtggagggggtagaaactagtatttttgaacatttgttatatatagtttcctaagcatttatacttatcagaagaaagttagctatctgagaaactctattaacttaaacaggccaatgaagagctgcttcaatgcactgaagcacaaatgcattacaatccctgggctgctgaggactaattccagactagaaacacttctaataattctaatgactataatgacaaaaagtaactaatatttcctgagcagatagtacatgcaagacttactaaatgttaagtaagtgttaacttatttaatattcaagaaaaacacatggtaggtaataggtcattaatagttagaaactgaggttcaaaacagttaactaatttgcccaaggtactataaatatctcctttgataggttaaatcatttttcttctgtaaaatggaaacagaccagttgattattgccatttataaaatagccttaatgcccttaaaaataaaaactcccttgaataatatatgaggagaaggcaggaagatgctagaaatgtcagcttattagagtaagtatgtattatattgttaacagccaccaaaaattcacatagaaagaagttactagagatcttcaggaagattacaatctaatcagacagataaaacacacacacaagaaattacttgaaataattaaataataaaatgtcaacaaatgcaaagtagatacataattggaattgaattctagtttctgtggaattaatatcattaaatcagatacaaaatgatggggcagggagagagtgggtgactccttctcttaaaggattcttcctgctttcaacataagctggtgattccaatgagtgcatgaggacaaatcaatgtgaagggcccaggaaatgctgactgatccaaacaaagtgaacctggtcattaatgttctcctaaaggtgagatttgagattcaaagaaggtgagacccattgatcagttcagaggagccaagggatattctgatttgaggataaggtggagagagcagattaggctattgatagactgaagaacgagtgaaaaagtagcaggtgtaaaggagggaggcaggagtgagagatgcaataaatttttctaaagtagctgggtcaggaaaatttgaagagctagataaagattacagtagaattcccagggttctatatttttagagggattctgggtaccaggaaaattcaataagaaattctggggttaggacataatttttataaaagatttattaaatatattattcatataccatacaactcacccatttaaggcatatgatactgtgttttttagtgtattcagagttgtgcaaccatcactgcaaccaattttagaacatttttatcacttcaaaagggaactatacccattagcagtctactcccccgtcctcctaataaccctagctgtaagcagccactaatctgctgtctctatagatttgcctattccggatactccatacaaatggaatcatacagtacgtggccttttgtgtccagcttctttcattaagcataatattttccagtttcatccatgccatagtatgtatctgtacttcatgatttttatggctgaataatattttattctatggacatatacacatacattttattaattaatttatcagttcatggacatttgggttgtcactttttggccattatgaataatgctgctatcaacattcatgtacaagttttggtgtgaaaataagtttttttcttttttggataaatacctgcctgtgagtggaattgctggtgcttatactaactctatgttcaacattttcaggaactaccagactattttttagagtagctgtaccagtttacatttctaccaacagtttatgagggttctgatttctccatatcttagccaactcttgttattatctatcattctgatagtagccatgataatgggtatacctcattatggctttggttgcatttcctagttggctaataatgttgagcatcttttcctgtacttactgactatatatcttctttggataaatgtttcttcaaatcgtttgaccatttttaattgggctatttatctttttcttattgagctttaaaaattctttatatattctacatgcacatccttaattatatgtatgatgtgcaaatattttctctcaccttgtgggctatcttttcactttcttgccagtgtgctttgaacacaaatgtttttaattttgataaatccaatttatctgtttttttcttttgtcacttatgcttttagtgtcgtatttaaaaaggcttgcctaatccaaagtaaggagtatttactcctacattttcttttgagagtagtagaattttagctcttatgcttaggtctattatctattttgagtttaattttgtgaatggtgtgaggaaggtgtctaacttcactttttttgcatgtgaatatacagttatcaccgaaccagatgttgaaaaaattaccccctccccgaccctcaccattggattgtcttagcactctcataaaaaattgatcatagatatatattcttattttgggactcttaagtttattccattgatcttcatgtatttccttcttccactgcgtgcagttttgattaccataactttgtggcaaattttgaaatcagaaagtgtgaatcctccaacttttttatcctttcataggattgcttctggctatgctgggtcccttgaatttccgtgtgaattttaggattaactcatcaatgggaaattgggatgcgggcttctccaaactctccaggcaaaactaatgttccatcaggattgtaaaccacaggtaaagatctgagaggaggcaaataacatttactgattacctaccatgcatctaaattctgcagtggtgaatttatatgtcttattgtttaatccccatggtagccttatggagcaaatactccaattttcaggtaataaatatgagtctaagaaaggttgtcttgccatagtttataaatagtgatgtcaagatttatcttaggtttccacattagttattctacctctctccccaaagaaaagtagagtagataggctggaaactaacccttccactcctatgaatagcctttgcatcccattagggatgcaatgtaacatttatgttgtattagactttatacatatatttcttccatttgtagaatgggaatgtgtggagtcattccagccaaaagcagaagaacaaaagaaaatgaatcatacattttcaatatggctacatcataaagttatataagaggaagaatacaaaagatgaaacatgttagtaagagggagctatggtggttcccaaatgacaaactatgataaatatttccccaaaaacaaaactacaatgagacaccccctcacaaaagtcagaatggctattactacaaaaacaaaaagtagccaacattggagaagttgtggagaaaagggaacacttatacactgttagaaggaatgtaaattagttcagccactgtggaaagcagtttggagatttctgaaagaatttttaaaacagaactacctttcaactcagcaatcctattactgggtatatacccaaaggaaaataaattgttctaccaaatgacacctgcactcatacgttcatcacagcactattcacaatagcaaagacagggaattaacctagatgcctatcaacagtgggctggataaagaaaatgtacatatacaccatggaatactaagcagccataaaaaataatgaaatattgccctttgcagcaacatggatgcagctggagcccataatcctaatcaatttaactcaggaacagaaaatcaaatgccacatgttctcacttataagtgggagctaaacattgagtacacatggacatgtagaagagatcaatagacactgggcactggggacccctagagtagggagaatgggaggggaggaagggctgaaaaactacctactgggtactatgctaactacctgaataacaggattatttgtacaccaaagtttagtgctgcaatttacccatgtaacaaacctgcacatgtacccgtaaacctaaaataaaagttgaaaataaagtaaaatggcataaaatgttatagatacatttatctatgccaatgttttgaatttgatattttactatagttacacaggtatagctcttggggaaaattgggtaaagagtatgtgggaccattctgtattatattttcaacttcctataaatacacaactatttaataataaatttttaaaaaagaaaaaagaggaggcaatgtgctgagttttcagtaaagctaaaattacttaaatacttctgaaattattttccttcctggtgtgtgactatatatgaaaaatatcttattaaataatagagaaaatgcatagataatatatctttttcctttttctctctttacttggagtaataaaaagtttgtaacccttggtaagtcttccaaaattgttaattttactttgctggttcaagaaggccaaatctagaaaccactaccatagatgacgggaagctactgaagaattttgaatattaagtggaatgaatctttagacttatgtgtaagacaaatcacccttccaacaaacgacgttaggacaactgcacatgcaaatgcaaaagaatgaagttgaacccatacctcacacaaccctccaaaattaacaaagtaaattatagacttaaatggaggatataaaactcctgcaggaaaacagaagagtaaatttccatgatcatggagtaggcaattactttttacatttgaaatcagaagcataagcaacaacaataaagaacaatagatacgttaaactttgtcaaaattaaaaacctttgtccttcaaagggtaccatcaagaaaatgaaaaatcaggacttggggtggagcaaggtggagtaggagtctccactgatcatccctcacacaaggagattaatttaacaactatgtacacagaataaaacaccttcataagaaccaaaactcaggtgagcattcacagtacacagtacgtggttttaacttcatatcaatgcaagaggcactgaagaggcaggaaaaacagccttgaattgctgatgccgcctctctcccatgccccagaggtgacagcatggtggagaatgctactgtgtgctggcaagagggaaatcacagcaactgtgacacatttaataatgtctcagggcatttaataatcaaactcccaaaggtcaaggatagcataaagatcatcctaaaagcagcaagggaaaagaagcaaatgacatacaatggagctccaataaagcatagagaacccagaaacaaatccatgcacctaaagtgaactcatttttgacagaggagaaccaagatcatgcactggggaaaagaccatctcttcaataaatgatgctgggaaaactagatatccatatgcagaagaataaaactagaccccctatctctcaccatatacaaaaatcaaatcaaaatggatttaagacttaagtctgagacctcaaactataaaaccactacaggaaacattggagaaactcttcaggacgttgatttgggcgaaattttattgagataccccaaaagtagaggccaccaaagcaaaaatggacaaatgggatcacctcaagttaaaaagctctgcacagcaaaagaaataattaatgaagtgaagcgacaacccacagaatgggagaaaatacttgcaaactacccatctgacaagagattaacaaccagaatatataaggagctgaaacaactccataggaaaaaatctaataatccaattaaaaaatgagcaaaatatttgaatagatatttctcaaaggaagacatacaaatggcaaacaggcatatgaagtagtgctcaacatcgctgatcatcagaaaagtgaaaatcaaaactacaatgagatatcatctcaccccacttaaaatggcttgtatccaaaagacaggcaattgcaaacactggtgaagatgtggaggaaaggaaacccttgcacactgttggtgggaatgtaaattagtacaatcactgtggagaacagtttgaacgttccttgaaaaactaaatatagagttactgtatgatccagcaatcccaccgctgggtatataaccaaaagaaaggaaatcagtaaatcaaagagatatctgcattcccatgtttgttgcagcaagaacttggaagccaaaatttggaagccaaaacttggaagcaacctaagtgtccatcaatagatgaatggataaagaaaatctggtacttatacacaacagaatactgtttagccatttaaaaacatgagatcctgtcatttgcagcaacacggatggaactggaggtcattatgctaagtaaaataactcaagcacagaaagacaaatattgcctgttctctcactcatttgtgggatctagaaaccaaaggaatagaattcatggagatagagagtagaacgatggttaccagaggctaggaaggatagtgggagggttgtggggaagtggggatgtttaacgggtacagaataaatagaaagaatgaataagaaatggtgtttgatagcccaatagggtacaatagtcagtaatagtttagttgtgaatgttttaaaaagacaatgaaaaatctactcacagaatgggagaatatatttgcaaattatatatcagataaaggactcacatctagaatatataaataattattacaatgtaatttaaaaatttgtctaatgattttagtagccatctcccgaaagaagatatataaatggccaataaatacatgaaaagatgctcaacaccattagaaatctgaaaaatgcaaatcaaaccacaatgagataccacttcacaccggcttgatggctactgtcaaaatgatagataataaaaatgattggcaaagatggagaaactggaatcctcatacactgctgatagggaatcaaaatggcacagcagttttgaaacatagtctagcggttccttaaaatgttggacatagaggccacacatgattcagtaatttcactctgagaaaaataaaaacacatccacacaaaaacttttacatgcattttcaaagcagcattatttttacagtcaaagagtggaaggaacctacatgtctgtcaactgattaatggattgaaaaatgtatgaggtccatacaatctaatattattcagcaattaaaaatacagatacatggtacaacatgtatgaatcttggaaacattctaagtgaagcaagctagtcacaaaagaccaaatattatataattctatttatatgaaatgtccagaataggcacatctatggagatagtagtttagttgtttcctggggctgggacaagggagtaggagcaggaataagaaatgaccataaatggggacagtgtttctccttgggctgatgaaaatgttctaaaattagattgtggtgataaatgcacaatgcagtgaatataacaaaatgcactgaactcactttaaatgagtgaattatatggtatgtgagttttatcaaaataaaactcttaaaaaagtcgggggaggatcactaagtgtcacagtggaggacaggatgtaagaagctgagatgatagacaaggatataagcaaagaccatgtttacatagttcaggaaaattaaaagcagggcttgaactaccatagtggcaatgggaatgatatagtgggaacaaatgcaggatgatgtggtggtaactaggcacactttctctctacatcatcaacacccacttgatagccactttcacccacttgagcgctactgtctctgatgggtagaaacctcactttatttgaaaacacccagagccaaacgtctgtccaccatctcctgagttggcctgcctatgtggagaatcatttaaattatttttactatttgaggcaaaatgtgcttgtctgcaacatctacccattgtctttcattgtgccttgtaaaagtaaatatattactatgataatgtttgaaaacgtttgtttaatagatgatccagatctgctggagattatagactgtatcaatatttgtacaataaaggtcagagagacaattctcaagttagaatttttgaaaatctaaactgttcatcagataggtagatgaagagaccaagccctcatgtggtgtcagaccagctttctcatcccaaatattaatacattttggttgcacatagaaggaaggcataggaaccccattgctatgtggggcttttactgatggcatctttctggaatcctgagaaggtactatccacactcctgtcattcagtttaattgaaatgtgaccctttcaggcaacctaacaatatgtttacattacacagaatttttcacttaagattccccttaatatttaactaacaccactaaagaataatgcgactggcactatagctgtatcagaatgggaaatcaatcagttttcaatcttgtttggcaaccctctcactaacccaggcagacagagacccggggaaggggagaaagggatgttaggccttgagccagaggtgaaattaaatctgctttgtatctattgtgaaatctgcctcactttccaagtgctaacaaagggacaaactgggagaggcaggtgcctgatgtgtcttctatctggaaaatcgggaggtatcccaagaagtcacgctcattgcttctgacactttctttaaaatattgctcttttcacccatacaatttttgtcagtaatcctcaaaggaagataatacttggaatttcaaatcagcagcaccttgatggcaaagtcaggtatttagaacccaatttaactcttatgctcccaaacagtagaaataaaaacaacaataacaataataaagttattttacattaaattatcatggtacagttacaaagtacttcacatatattgtcttaatttacccagtggagaaaactgtgctgtttagctattcaatatatgttttgtttgattttattatgaaaatatatgaagcaaaaagtctttctccatagaaaaatcaagtaaagcccatagaatagttattagcctagcatatatgagagtgctcagtgtaggttctttctcccttctgcccctctaaagctactttggctaataggcagtaaatgttcctaataccttcagcagtagagattagttatcatttcccccattatgtacaagaaggatccattaagcatcccaagtccagggaagggaaagggatgccaagaagtagacaagaggtacgagagtaccacatccccctttctcccacaaagacaatcatgccaagacagtaggctgtgttcttctgacctactagtttgctcctagttagaccgtagacttaatcttgcagcattggttcttgtggaaaacaggatgatctgttggaataaactgagtacctgagatacaacacaaagcaggtgaagcttgtgtcagcgcctctcccttgcatggacccagtgggagataaagagattatagaagaaaagaaactgaattaccaggtcttcaataatttgttgtgatctattttttcattctatttacttttaaacctactttgtatttgtaattttattttttcttaaagattctcacttccttcagtaatataggccacacaagctagatccacccttgaagagaacttaattcaaaagaatcccacagcaaatgactgcaaccttcacagccaggccagattcaggattcaatgctaaattagtggtggattcactggtgatgccaaattggtgatatcaaaagacaacaaaccaggctcaaatatgcaagttgaatgcagcattttttttttttttttttttttttttttgagatggagtctagctctgttgcccaggctggagtgcagtggctctatctcggctcactgcaagctccgcctcccgggttcacgccattctcctgcctcagcctcccaagtagctgggactataggcgcccaccaccacgcctggctaattttttgtatttttagtagagacggggtttcaccgttagccaggatggtctcgatctcctgacctcaagatccgcctgcttcggcctcccaaagtgctgggattacaggcgtggcagcatttttattattctgaaactgatctaattttgatgaatttttaccttcctcctaggtggcagaaaaagttcaacttgttagttctgtttcttatttttgattccacttaaaatgctcccctgcaagaaaattcttgcccttttcagaattcttcccttccccatttccgtttccaaagatgattgctgagtacaagggtgggaggatgtctctcagtccggtgtccaacgggaggggcccctctgatctcatggagggtgcctgtgccttttgctgggctcccattgggtcagcattaagggggctgcctatgctgacaacaactgaggacacacccctttaaagctcaccaaacactgtcctcctgctattgacgtctagaatgcagaggaagctcctggataccttctacaccacacaggcgttaaagattttggagagctaacctcagggcatgttactttggtggagctaccactgtgatctcctcccagagcacagttgtccccctcccccaggaggcatcaggatgtgtcttctctctcccctaggaaaattccatgtcttcatttctccccacaggaaaattcctctggaaaatagcaggtccttccgttttctcttcctctcttgaacgggcttcctcgaagtcatctccttcttactgggtcactaagcctcccagctcggtagacatggaagaaaaggtgtccttcctgcattatagaaaaagcacagatatgccagatgtgtgcttcaggcctggttcttgatgtgttaattgaggctaacaggttttagatgattcgtttcatttctaacagaaccagttgttcaaaactattgtcttgtttccagtgccaaagctgtggatattcaatgatgtttatcactctccccctgccgctgcagtcctaccctgcactgctaatcctccctcagcaaacagatgcccctggaacaatgtaggggtgagcacaaagaaattcaggagaagaaagtacattcatgtaattcaaaattgttatctctatcataagattagtaaaaagcctttgttcagattttttattgtgagcagtgttgtattttttgttattgtttcaagggataggttgatattttgatatcacttagaaccgagtcggtaaactacatatttatctttgatcaactaagattctgtttttaaagaaaagaggacatctttggctagtaatgattaggtaacagtgaatggcaggtgccatatggatccttggagcacagacggacatcaaccagcaagtatttctcagattctaccctaaaatagtgacagtatgtcaggtgtggactaatatatgtaatagctttcaaaaggaactgaacaactagcaagtaaagagtaatttatattaaaagatcccaataatagatggactatggcaagaacctctgaactagtctctctgcttcttctctacctctttacagtgtattatctacactgcaatcaaaatcttccttccaaatgtaagtaactgttcaatggcttcccatgggactcggaataaaagctcacactctttacaatggccctgcaggttcctcatctcctacctccagcatcttcactgtccctctgctccaaccacactgcctctttcttattcctccagacctcccaacacagccctgcccccaagacccttccaatgactctgatcctcttccctgcgctacccagtgtctcactccatcgattcctccacatcctgccaaatgtcacctaaccagaaaggctttgttgaaccaccccagataaaataaagtcccctgcctttacccatcactctctcttgcccggtttaattctttctagcacttacattgtgataatttcttttctgcctcctgcctcttttcattggaaaatatattacatgagaggaggtttgctttattcattgctgaatgttcagcacctagaataatacctggcacaaaataggtcctcaattattatacccaattcctcccagttctcttggaagtttctccattttaccattgaaaattccacatccttgtgattcactttgtcccagtgaattccaaacagttggccatcctacccttaatagatagttgttgaatgaaggaaaggaatgaagaaaaaagaatgaggacagggaaggagggaggaatctaggacagaaaagaagggagagaggaaaaaaaggatgttaatattttcttgttctatatgtagaaagcaaaagagtatttttgtaatcttttttcagcaaatgcctggatcaaattcaatatgattttaaagccatgagaccctctcattcttggttttgatgttgcacggtatcataatacatctgattggaatttcaatatcaggtttaatatactatgcaagctggtataggctctgaaattatgcatattcatgagagcaatcacacccttacttttgatataactggcaaagtaaggtaccacaagagaacaataatcaaagaaaaagggaggactaccagttgttatttacttatgacattttactggaaaaacttaagcaacatgaaagactatttctaaatgaagtactaaaactaacaagacaatgttataaagtgtcatattttctttccttttatacaataaaacattgaaaagctccaccactatgcagccacttcaccagatgcaataatatccaaatgtgaaagtaattaataatattgtagttttaattcccttggtatttcagagatatcctttgaacagcctaaatcaaatcatactggtacttatgagaaatagatatctcttgtgagtccttatattgtgcttcccaagaacctacagtgcatttcagttatttaccttgaaaattcttcagcccatccagagtgggtttggaaatttgtaatcattttgtagaatgtgataagggaggacctgtcttcctaaattctcaagcttggaattttcaagtcagtgtcaggaccataggctctctaatgcatatatatttgccctgagcaaataattatttatctctgtgcttcggtagttgcatctgtatgttaaaaataagattattgctatgttgatttcttatgacatgagagaagaggctttaaaaattaaagaaaagaagaaaacactttaaacttaagatgggaatcatatcttattctttcatattcccagcgcctagcagaatgcctggttaactcaccgggggcattagccagttccttgtctactacatcattccatcttgtatcattccacgctttgaagcaggtactattacaccctatttgtaaggcttagagaggtctagtggcttgcccaagaacagaccacaagtacacagcagaggcatgattagaaccctgcccttctaactgcagtctggtgctctttcctggacacctgcacatctcttccagtaattgaactgacctgcatgttaagcatttcacattgctctaacacaccaaagcctatctacagaaatgttcagaaagatttgttcccaagccctcttccatgtcatgtatgcactttgttcctggcactctttgcagaccatctctctcccagcatgaaagttgtctataaaccctgtgtagtcgaattgcaatttggaatctctacaggagcccgactacattaaaccaatgcatggattaacacctacttcaacacacacaaccattctccacgtacatgggcagtttttacccaaccaaacaataacagacaggttctactcatacagaggaggcattgaaaggcacagtagaaacacagacacgcagtatagtgcttcgtgtccaggtgcattaatgagctgtggcctcaaatcccaggttcgccaagagtgtttctgctcatgtatcaaagcaaagtcatcctgggtgtgagtggaaatgctagttgcattcatgtcagcactagacatttcctggaacccattaaacaagattcattttccaaatggattttgttaatttatttttttttccttttgtagttagaaacctaggggaaaattgagaagaataaatgtggttaaactgccccaggggatggcttgtctgtagaagcatcccaggcataccgaatggcgtacaaaacagaccttaatgagtactgcttgtcaaaggatctgatatgcattttgcagaataaacataactcctttttcagcagttgatccactattctctagggaaatgaatgaagggccatatactgctgtctttgctgcccaaacatacacttgtttgaagggaaagcaacaaaaacaaaacaaaacaaaaaaccctgctggtttctctattttctaattacgttttctttccaagacatattttgttgtattggtacaaaatacgttcagtaaattcaaggaggagaaaacattccagtctgaaatggatttcagcttggcaaaaatgaattaatagaggcatggcaggtcacttatttaactaagtacaggggctgccctattaaccttgagtgagctgagagaactaaagaaaattctttgtttgtcctactgcaaaattggccaaggcaaatcaaaacaagatgcctgggcaaatcaaagtgacacgttcaaaataaaatcatgttaatactggttgcaaatgaaactttattagcaagtcaactttagtagaagtgctgtctgaatgtaaaaatctgactgcttgaaaataacacgcccccagtaattaactctcctaataggactacaattaagatctcgtaggacagcatttcgggaatttcttcctgcttattctcaccatatatatttcttatggctgcaggttagtttatacctccaaatatcatatttctcactagaaatagcactgagtaattgggtgctgcagggcttactgttcaatactgagtcattttgattagacccatattttatcacttgtgccattagcatcagacatttttttaagccatgaaactcctatgttcttggatttgatgttcataaaattaaggaaatcagtttctaccatctatttttctcttcaaaaatcaaattacgtgacatctcatccatgtcaaggcagtctaaatcactgatcattttccatctgaggctaggtgtgaagctaatccattttctgtaatgaagcagcgaagctaaagaagggctgagctatactctgaactatggaaataatggatctaatttagatagttaatccagccatttctgaatagtgtgcactcatgtttgttgagctaataatgtccatcttaaatcaagaagacatttaaacctttatggaatatctttataaaatatcaacctttatggaatgttattaaaaatgtatgtatggtaatggacaattcttcaccagtgctttggatattctgccctcagaccaaagatgcttatttttcttccttccctctcttcttccttttctctccctctcctctttcctttctttctcttagatcttcagtaatttctctgtactccatgcagcatgtgcagttgcttaattcaatccatcttttctttttaaaaatttttccaatctcataccttcctctatttactatgataaaactcttctatacttcataggaaactacttaaaagaagtatgtaccttcaatgtctttctccctaaattttcacttacttctaactcaaacagttgattctttatactaacacatgaataaacttgccaatgacatcttatgttgctaaggcttatgcgtgcttttattgtgtttgtttttactcatttttctagagcatttgacatatctccttgtcaaagtgttctcttctcttgccgtgggggacaccactctggttgttctttcttcatttcctttcttggatctcctttttcacccagaaatatcgttctctccaaggacttttttcttggtactctcctttaatcgctcaatgatttcatacaggcccatgtccttaggtgccacttctttgttcatattcccagcctgctgagactcaaataccagtgctcttctagatgtctctacttcagtacccttttagacaactaaaacctcaaactgtccaaaattagcccctcctttcctctctcgaaattgctctttgacttattttcctaatgttgctaatggatgaggcttctatccaggcctaaaactagaatctcagttatccaagtgtcttttgcatttaattttacaccagatattatctattctatctcctatctgtgtacgtcttcccattcataatgccttttaattgtcatttcttcagtgaattacaaagatatcttctgaaatattatcccttcttctggtatggcttcctgcaatattcaattccaatgtcatgctcttgattaaaatctttcagtggtcgctcactgtttctagaccttagctggaactcttggaccaaaaaatgtgagctacctctgtatccacctactttttttaaaaaggcaacttccgcacttataagggacagtaatccttgtgccagttgaaatattttcacagccatgattttatcacagactgtaggaaacagattctcttgcttctagaaagcatgttttgttagggaactgtgttgaattcttcacctcaattaacctttattttaaaccttctgagcatcagaagtatttactatcttatattataaatgcaaatactttttcctggatcaaataattgaagaataactaggattatgaatgggaaagaaaggtttcctatgcctgagtgagttgagttgctgttctttgcttatcatatataaagagtgagtgaatttattatcatcctggtatgtacatgttaactcaaaattattgtggtactcactgtactttgtactattgggttccaatggtttgtaagctagtgatttatgcacataaatccttaattcttaactaagaaaatttagaaattttaaaatttaataccctattaagaaaaaagggtgaattttcctgtgctctcttatagcaatcatcttatcaaaaattattgcccttttgagaaaagtacatcatgataacatcactttgtatcttctagctttctctgatgttaggcattttttcttaaacaagttaaatattcctcatggaaaaataattagccaattccttaaatttgacaaaaacatcattcagaattgttgctatcattccttttttttcctctttttttggatattttatgtccaggcaaatgggggaatgattggctttatattctttacatgaactgtcttttttcctgcctatcctagtaatatcacagcatctaatttattttcttaaccacataacatatcctttcctcttttctaataagagaatatagttaacttaggcaaatgaagcagtgcctgtgacatattaagtgctattaaatgctcaataaatgtttcatgactgaataaactcaaggccaggtaaacataagaatagagaaaaaataagagtgaagctgtgattggtagttttttgtttgtttcatatctataacctcttggtagcttccccaagaatagttaattgtccatgtgaccaggactttatatccttatgtcacctacttctgcttccttcccccaccagtttctgggaagaattttgccagatcaccagatgcacacagttagctactaaagaatctcttgtctgtctctttagcttctccataaatacacacatttcttcatttgtttttaaggcaatgctgtatgtgtaatcatgtgtgaatctttattgaacacttatggaataagccacctgttcttacaaattagctgagttctcaagaaggcccaaattagtgaattagttgatgaaggaaatttgttgcggagacagcaggcagctaagaaatttttcagcttgtcaaaggtattgttagtctcacagcttggcaaggagagaagaagataccattttgaagaattttaggtagtgtcttaataccttacactcactaaggacgaaaatgaaattgcttgtcttatcagttaaagggaagctttgctgatgtcagaccatagcccagaaagttaactaaaagttttgtagaagtagataatcttttcctggtgatcgatgtggtgagattggaagtgagttgccaggggagtcatggggaaataggcttaatcattttatttgtatttgtgctgaaggcagtgctgaacaaacctctgaagtcacttagccatgtcttttccagggggcatgcaaggcgactgctgatttctacagacactttttaagcgattaccagtgctggcaagtggaactacctttccggtcctcttacaagcatccagtcacttgctgaaatgtcataagcgatataaacctgctgacaggccaggatcattgcatctcctgcctcctccttccacgtaacaaatctcattgttgattggcatatggcagcaagcatcccaacacccagagtggtgttcttatttctgagggagcagggtctgtgtgtgaattgcacacacagggagcaatcccctgccctgatacaggcaacctgagtgcttagttccttctctgctcagaacttagtgtgactatgtggcctacctcacattgtttgtgttacacctacacaggaaaaaggaaaaatgtccttttgattccatgcttgtagagatgttcatccaatttgaatgaacatgtagccaaggtagtgtcttccccctttcttctccttttttttttgtctcataggtgtaataacatttcattttaaaaataaatatgaaaaatggaaaagcataaataaaaaataaacacatttgtgagttttttatgcagatataaatactgttaatattttaatttttatcctctggccttgtacttctaggaagtaatgaatggtctggttctttgggtccttggagccagtgtgggtaggagtggggttggcagggacagtagagaaggatgcaaggaaaatatttgctctggatagataattttgtctttttcatccaatcttatggggaagaaaatgttcaaaattcaataaatattcattgaacacctactatgtgctaaggactatttagatagtagaaacactgcaataaataatgcaaaatgcctttgtgaaagttataatctatggaaaatggaagagagagagtagaaatacccagtatgaaacttgacaattcaatacaaagtagccaaattatttaaataaacactttaagcacctggtatatggcacagttttgagtgatgatgtgttaaattcaaaatcaggaatttttatctaaactgtgtatctacaataatggattatataaaatgagacagtcttataagccttgtttctagatattttatagccttttgacaattatttaagtctgcatgtagaatttatcaccacttaagtagaatctattaggaccgtagaatctcagagatgaatttaaatggtctaccttctctatttctattatctatactacactcctgctcccatggctgaatcctctccctgatacattaagcagtaattatcagcctctttttgaaatcttcaggcacaaaaagctctctacttcctgaagcagcccattccaccaaccagtagctccaattttcaaaatgatcttccttatattaatctgaaattcaagggcccatagtttcttccgctgaaagtatgtgcaagtctctgggaactatctcaggcagttgaagcctggggatatttcttttccaagtttcaaagttcaaattgccagaaagagccctgaaagggtctaaggtgttaaaggtgtccgtaaaactgatgaagaaaataatagcttgtatcaaagagcaccagtagcatgtggaagaatgggttgttaggggatatggctttgatctgccactcgcttgtcagcagagttgattcactcacttggctagttgagaaggtggcccttcctccatgtgtggtcttcctcaagccccatgctaaggcaaagaagttgacctaagctctgtcttccataggtcaaaggtacctgaatagttgagttattttagtagaaactctgaatatggaattgcagtttgaagcagccaaaatattcatttttatagctgagaagagactctaacatgcagaacatgttgtcttggagaagccagtgatgaaatgtgttggtttgagccatagcaacagttcacctttatatgcagaggaaatggaaatccattttaatcatcaatgaaaagataatcattctaaagttcctttccaacatctatcacaaacatactaagtttccttctaaaaataaaacaactgagttttccctccatcttgtgattttcaatggaacctgaaagctggtgtcctatcctcttatgcccttggtggccagtcaaaagagaacaggttttattcattaattacatcattgatttattcaccaaacatgcattgagcactcacgctgtatcagacacaatcgttagtactaaatgtaagaaatcctgagatcctcaaataaaatagcagaatatgggtggatttgagtagactggtttagaagatattgaggaaggtgatttgatggtaactaaatatgagagtagtgagcgcattaagattaactctcaagtttcttatatgaggagttggggagatggtggtaagtccacaaacttgggtaaggcacccaattttacaggagcaacatactgaaggaaatccgtagggaaaaggtgaaatggtgtatttaccaatgatggtatttgggcatcagggtctggaagctcttcttcagatatggaagcccaggcttggtagtgtagtggactttatggtagagaagtagcatcttttctataaagaaccagattttctttttttttaaataagagctcctggttaaaagctgtgtgtcagatcccatatgggggctctaagatctaattttacttaagggccccaaggcacagaggctagccaagattctgagaagataccaaataaaaatcttggaaccaatagaaagcaattttcataattaggaggaacacggcaccccatatatcatcattagtctgagacaaggaacagaaggttggggagggaaaggatggtttctctaaacagggaacaggtggccagtgcagtcagggccagctagggaaaccttaggcaactctgctcgaaaatttctctgttcctcccctagaaactctcagatacagaagaaaacaggatgattagttattggcaattagttattagttattggcaatgggtgtttgcctccatgatagtgtttttgttcttaacagagacacagagaaaggccaaagggtagaatttaatggcacccgtagacactgtggaaaatgaagtgtttttgtatgtcctgataaactgaagttttgatgttacaaaatgtccaaaatgcaatttggctttcatttgaattgcttcctgcaaagttaattgtttgctcccaatccataattgatgatagcttttcccctattgcagttagaccaaggaatcttggcagtctagtgctatagaagccagacacatgcaggtaataacaccccaagaagagctgaaatattagccttcggagacacaggctgtgcaaatttctctggcttacaaaagagacatcagttacaccttagagcctgtcttgtagacttagtttcataaaagttgtataataattttggaaagtacagatgacatgtcagaaaaaatgccagaggaaaagctctggggagcctgattaatcagtttcacagtaggtataaggaatgagggggttctgatagctaaagtagtgatttgcatgtctaactaattttcttctgccatttcttctccattcccatgatatccagtacagagtgaccatgcagtgttgattgatcgaacagcaaccaccacatacatgtcctgccccaccacaaaaggaaggaaggaataaaagaaagaaagaaagaaacaaacaaacaaacaaacaaaactaagcaagacaaaacaaatacccatgtcagtggttcaaagattaagattgtggctttgtgtaaagttctttccctttgtagacttgctgcataattattcaggtatgatggttacagtttttaaaaaggaagggaaattgtggtatgtggtatgtaaatatttttaaatgttgtctctctgttttgatcagtttttgttttattcaatttgtctttattaaatcttatcaaagcaaaacttgttcttcccatttctctgttttgattacaggactactgaatggagagctttctgatttctccaagggaattgttttgtagaaaaggccatgctagatttcccttgccactgcctctttctgcttggaaggtaacctttaccaagagctatagcctcttaatcttttagtggaaatcgctcttgtgaaaacgagccctgatagtatcttggctcactaattcatgccatgccgctcaaaattaaagcattaaaatttcatagatataataccatttataaatcatgtcataaaaacattcattttcttatagaccttgaaaactgggcatgtattcctcctccagctgttgcttaaagttcattacagcacaccagtatttgtcaaaaacaaagctctggtaaagtggggagatatttaggagcaacaccctcagagcatcaaggcactgtcctcccagcattgtgcacatgttcctcccattagtggtcatggaaactgcaagcccacctctgtgtaatcagagattcccggcagaattgtattaatggagcaagtggttctgggagggtagctttatcattctttatgtccttattctgttcacttggagaaagagactatttaccattttccctaaatttatctcctataaaatttcaatatgtttagtggatgaaggcaacagactaattaagtagacggtaaacatttgccacatttcaaaaaatgacaatgacagacgattctttttgccatttacccttaggcagcagatggggacttgataattgtttaagcagcagaaataacttgccctaatttactatctagttttttgtttgtttgtctttgattatgcctgaataaaaaccttttgtccatttgaagtggtggaaattagaatatccattttgaggtgtttctgggatgtacatgccacatatttggcttgcagatgctaatgggtatctaatcacatttgccaaccataaaatccctattggtaaaacacttacatctgcaataatctgccactttcttgaaacatgctaattttcttaaataatgtagaggcctataaggacttctattttatgtaaacaactagatgtagtaaacaatcagttgcaagaggtcattatatcataatctggactttgttacttttcagaagtttggggtttttgtttgttggcttgtgttgtcttgttttaatttcatcgggctagcatttcatagtagagtattaagatggattctttgacctttgatatgaaaagtagctgaaccatctttttattgcttgatttgttggattggagaatattttatctattcagtattaaagattagccctaggaaactgggagctgctctaaaatatggaatttctaagtcgagtgcattttctccaggctaaaataaacctagacacagatatttgatagtgtagaattcccttaatcttttaggcacagcatctgtatgctcattcacatggactcgttttacatacactacctacccatgccaccaggatcatttatctggtatgtaaaatctgatacgtgtttttgtgctaattgaaatattggtttgtttgttgtcagcctcagatgccttctccaacaaggctaaaaacaatttcaagcagaatataaataagacgcatctgaggatatacctatgcatacacaaatttgtgtgtgggtggacatacatatattctacacaaatgcactgagggagagagcaagagtgagtttctattttcattctgtcgtgcttacgtatattcatatgatttcacattgggtatagctttggatctgagaaaaccagactattatatgtctggtaacttcactggaaaatctgaaagaatctaaattagccagtcctgctgatcttttggatacatgaattcatatgtccactaatttgttttctttttgctttttattgtggagaggggagaaatccaaacatacacaaatataaacagaataatataaaagaaacctctatgcatcgatcaccagctccagaaaataccaactcattggtctctgcagccccatcttcatcatcagtcacatcttcccaacccttctcccacctgttttttttgaggcaaatccaatagcatattatttcatttcaaaatattttattatgtactttcctaagataaaaacatagtttttatatatgagtagaataccaatcccacactaaaaaaattcaccgtaagtcttaatgtcatcagatctccagtcaatgcaattatctaatgcatcatacattttttaagaaatcataattcaaataaaatacatacattgcttgtccatagattgatttatcttgagactttttaaaacatatgggtactcctctccttttctttttttcttcttgcagttcatttgtcaaactgcaagggaaaaaaatgattgtttgtcctgtagcttctcacagtctagtttttgctgattgcatccccacgatatagcttaatatgttctttggtctcttatttactgtacttagtagttagatctagaagttttattatattagatttttgtggggttttcttttgataagacatttacatatgtggtcttttctacttaataaaaagcacactatatgctttatctctttttgaagtgctagccattaatgttcaatgcctaaatccattagttgattagagattacaaaatactggtattcttatcttctcataccttcatcatttattagatgtgatatttttataataaaaatttcctcctttttattctttggtgaccagtagtacaactagtgtagccaagggaggttaaactcttgattcttttatttacagttttcaaaattatcattagttccctacagtatccctcggtactcaataattttttactatcatgaagaacacatggatttaaaatttgttgaagtatttcaatctattgcatttacatcatccctgttgatgctcaaattgtcccatctttggcctgtaagaggctctaacaggttgttctacattcttttgacagattcatgtccactcttcactctgtaggggatatggaatcccagggattttggaaattgctgctaccctctccctttcactaggcctacgctttctgtttcttgctctttccggatgttctgtcacatgactttaacttggagatagctcctgaaggagccagtgtttatatgtaaattattgagaaacacaaaagtgccagaacacattagttttcaacaacctgttttattcttctcacatttttatgttatcttagggaaccagcttcacctggtgtttggaattctaactttttggtagccccttagccccaggtagcaaattgctgtactctttttgtgtcttcatcactgtgtggcttgtggtagtcacttgaatacttgttgaatgtatcagtgactgaaagaacaaataaacaaataagctcatgatctctctttaatttaaggcataaatctattttagatatggtgccatgaaacagaacaatcttagctgataagagagagttgatattgcatgtgcagggtgagagtacatttctgagtcatttgggagaggggcttcaataggaaactgtcccttgaatggaaaagcattccctgtacagtctttcagacactaattttgacaagcaccaaagcaagacacatgctttggagtgttatgggattttatgccaagaggttgaaataatttaatggatctggagagggtggaggtagcatagaattatggttgctttatccatttttttctgatctgtttaggtgatttatctattctgatttccctgaattgtttagtgctgagatttcatggaaataggtgttctaaaaaccactaaatattgttttttaattacctcacggcctcaaaggaacaagtaatcctcatcttctttttattggcactaaaattctctataaccaccagatcccataaagatcattctttttaaagccttgttttttactaaggaatgttgattttctagatacatcactgcaggatggagtcaggcaaagaataattattgtcattcaagtcagtgtttcataatctatctgggtgctaagagccaccccaattgggaagagtgcatgtgttataataaaattatctattcaccagacaaggaaagcaataactttgtagcatgtcatatgtctgtgttcacatatatacacagctggggagcaatggtaaacagtttcctaaacactcactaaattcatgcttatcaagtgtcttattccttaaaccaatagtctacacagacatttttactgtactcactccaaagtaaataatttttgagcatttaacctcagcaaattaggttgaaccatatgaaattgacaatttgtgggtcaaaaatacttgaacattggcaatttcatatttttcaaccttctaattttattagttacaaatatgtacatatgttaccatcatcattaattaatataacaagcacaataactctttgggtaaggatcaataatatattgggtgtaaatctgcatttccagtagtctcttgggtaatttctaaatcattgagttagttctgatgagatcagaccatcacagtttttactctgatactgtggctagctagaaacttgccctaggagatatgtcagctctgacagtttcttcttgtgtctaatgtgcttgccttgttactatttttagtcaatctatgttttctttgcagaaatctttttacgccgcttgtccattttgagagggctaattgataagttgaaactaaataatataatacatatataaaccagtttgactagaccattttattcagaatatgttgcacagtactcaaagagaagatttcacatgttgactctgacgtgcagatgaatgatggtgccgtagacaattaggatattagattttagtagaacttaatttatttctaatttttccagtgacacaatggatataaatgaaagttcaaacctagtttgagttgtgcctcccacaggcagtctttccatgtggcttggatttataacaacttggtggctgggttctgagacagagcatctgaaaagcaagcattccaagaaatcaggtggacatcggatagactttcatgacccagccttggaaatcacatagtgtcacttcctcatccttaattaattaaagcaattacaatcccatgtagatttaagaggagggtacatagatatctctatagaaggaatgtcaaagagtttgtggccactgtttataaaccaccacaccactcaatgcataaatcccttaacaaatggtcatccacatttactacctctactgacaaggagttcattatcacagaatgtaaactattccttttttgggacagtattaagtattaaaaatattttctcaagcggaacaaaaatatgctttcttattacccagtttttgttctcccttctgccctccggaacacagcaagtcagctttcctttttgcttggaagtagttttcaagtgaattgtgttttcttttggatgttcacactcctagttgctttgactctttcctatttctctcatcatgtggttatcttctaagcagacaatactttatttctatttctcttaaagtactactaaatttgaacccatgtaccatttaatactgcccctgcagactgggttgttaaaatactatttgcgtatgtaatagtttctcaaaagaattatctatagaacaatttattagtgcaaactgttaatatataatttttcagatactcagagtgccagcatactctgagccaatgagagctgatttgggagactataccggatgctgtcaggcagcaaatgtttgtgccccatatggcaaatgttctcagccagtgaatactctattgtaccatactcagttgaaagtcttcagcaatgtttgttatgtacccctcaggagcctttctttctgccctatatttttgtgttctagtgaactgtttgaaaccataatggccgacaaaatgtatgcaagtgatagtgctgagactgaggcaatgaaacccaggaagaatattccactggctattgacatgcagggcttccagcagtttgagaagcctttgatgaaaaggtcaaagtaacagatggtaaagatcagcaggaaattagggattggtataagtccttttgacattctgaagggcattataaaacatccctgtaggattgcccaacagttgtttgaaaaattcctagaagaagaaactaaggttgaattatgtcatgacttctagtgatttaacaaaaatgaaagagtgcctgccactgtataatgatttaacaaaaatgaaagagtgcctgccgctgtataatgccaggaactcatctttacaggaactatgtgcttaggacgctgtgtgatgcagatatactagctactctttctttttcagaaatgagtgtcccacaccacaatcatatttccatattctaggtaaattttgatcagagaagactgaagtagaattaattttcctacaatatgacatttttcatcaactacttaaggtgactttagctttttaaacagctacataacaatgttgacccatcttaagcttcttcaacaaagatctccatatttttttcaggtaaaagtctacaaagcccaattctgttcctcaccaccactctaatatgtaatctgatcatggtggtaatgaggaccatgactaatgtttattgggcacttgcttagctccaggcacaattaagtgcttttcactatttcaggaaatcctcaccacaaacctatgaggtagttgcttttattatccctatcttttgcatggggagtattatagaagctggataacttgcccaaggtcttatagttagtaaatggtggagctgggatcagtggagcagttgggatgatgtcagatgttgaacatgtcatttataatgtcaaatatctatcccaggttggattgtatttgtaaactacatgacagcaggatttgatctgaaacagtgcttgcttggttcagaataaacgctgaatgaatgaatatgttgtaagcctgttgatccatgaattcactaataagcatctgtgatgcaaagcccaattcctcctgctgcaaatcatgtctgtcaatcttaatgtgtacagaaaatgttttttaaagccatgatttcataattgtagggttccaggaaaacatcctcttgggagagtcagcagcattaaggcatagcaatatttttgttcaggatgcattaggtatctctgattttccaatatcttaaatgctagcagcagcttcagatatgaaattacttagtaagcaattctaataggagaaacaagatctaaaagagaaacatataaggaatcctacttctggctctcaatggaaactggcatgagtcatgctagctctaaagaaatatggtatccaccactgaaatcatgcaacaaaagaaacttagctgaaatggttgaattgagctttctcaaaggccaattgacctattttgtccgatggtatgtggaaagaaatgatatacgctacttcccagcagaaaatttcagaggccttatgtaatatattgccacatggggctttttctctgtcacgaggccagcaatatcccaaatatgagtgttagcctgggtcccagagtgaagaagacatctacccagcccattatgataaagcagtactagcaagaaataagctaagtccttgaggacttgggattgttaccacagcatgtgtaacctaagctgactaaaaaattataaatattcttggccgggcgcagtggctcacgcctgtattcccagcaattttggaggccgaggcaggcggatcacctgaggtcaggagttcgagaccatcctggccaacatggtgaaaccccatctctactaagaaaacaaaaaatcagccgggcatggtggcacgcacctgtcatcccagctacttggggggctgagacaggagaatctcttgaacttgggcagtggaggttgcagtgagctaagatcatgccactgcactccagtctgggtgacagagtgagactccttctcaaaaaagaaaaaaaaaaaaaactataaatattcttaaggaaatcagggctgagggtggagaaacatgttaggcataagaggaagaacaacaccttgcagtcccaggcgcttccagagaggcgagagcctaagcgcagacaccacctccaaggcatagttggacacactgggtggaagggcaaacacagagtagatgcacagttcatgctggaaccagatccacagttgagggcccaggaataatatgaaagaaaacagtatcttcatgtggcagaaagtgaataacatttattttagcattcatttcatctaatcttattgctcttccctatcataaccaacccattccataagcccttccttagaaatacatagctctctaccatctgtcagtaccttaaaatcaatcaaatacccagtggatttttattttacttatttattgcttaaaagaatagctttagattatgcatctcaaagtctgtggcattgagaagtcactggcctggaataccctgccacctgcaaaaatcaactaacctatctcacttcaatccatttcaaatatttagtttctaattagatttcatttgtgaaaagggttctacaaccaaaaatgcttaaaattactgcttctgacgaggccacgggctcatttcaactactttgaaatgattatcatcaaattctgtggactctgttttggtctgtcctaatctcaacccttcttttcagagcatgtggcagaagcagcttcactacagagataaatattcatgtgcattgcattttgctcacaggcactgtataaactatatttagaagtctgaatgttgagatgtactgtgtcaacattgaaatttaattactgtgatggactttaaatccatggaccttcttgcactgcggagtgaatattacctcttgtgtttcttcattctcctttacattcctatagaagagggttgcaatctgcttaactagaacacccacctgcccttctcctccaagtgaatgaaatgaactctcagttttacgactgttttatctttgtgttgtgaaaaagaaatattgtcttgctaaactctttggacacttcccaatatgcactatctctctcctactcctattatcactcattctggtaataaatgataatgttcattgctaggatttgtaaagcactgtcaagttagcccattattttaaactcaggttaaagtaaggattttagatttatgtaagcctggtgcagtttcattaagaaccaaaggcattttaatttttctccctctacccaagggactttacacttcttaatgtgacattaatcagtgttttaatatttcttcaaaatgtatctattctctgcatgctatttaccgtctttgtcaaagtcagtgaacaggaataaaaagtaactacatgatatagaaactatggtcttcttggcccttgtgtaatagccaagtggatgctgttaaaagtgaatctatccatggtgcctttcctatttctgtacaggattttgatttcattttaaatgaatgtcataaaccccaggtctgaaaactaatagaatttttgcatttacctactgatccataacctttaagttagactgtgtgtccatttgcagtcagttcgttggatgatgcaatgctttaacactgaatgaaaagatttctgctatattccagacaccagatatgaaggccagtttgggtggattattcttagaatgactttatattagtcctgatgggtagtacagaataagctgtaggagctagctacagtcccttaaatgagaggagacaaggaaagagacgtgtttgataacatgacaccgactcactttgggaggtggaaggctaattaggagtccagggattggcagaacatattgtctgagtcctggtcagtacacagtgagtgtgtacactgttgctgactggctggtccccatggagacattactgctcgatcagttctcctcagcgcctgtgtgtccagagctgtgactgtggctttgagatgcctggctgacgggcaaagttctctagatgctgagagtccggcgaacatgtggaggaggctgcattctgctgcccgtcctggccctgggcagtgtgatgcagcatatgcttgcacacaacgaatcaggtccaaatcccacttctaggcttactggttgagtgaccttgggaaaattatttaatctctaaattggtctcttcatctgtaacctgatgttggtgtgaggattaaatatgataatccaggaaaagcatcccgtcaagttctgggcacgtaatggctcttgataaatggaatttaaaaggagagcctgtccctcaggcagttcaaatctgatctaatgacttccaatggatcaagagacgtggcatgtgggtggaaaagcctgaaggctgggattggtgagtgggacgctcaggttaccaacaggtgtagacaggtcctgctactggctgtggcagcaccagttctccataaacatccatcggttaggatccaccaggccttgaggagagtaaagagggcactaggggacctatccctgggagacctggcataaatccaaaggagaggaaggtgggaaacagggatgatgaacatacagagcacatgtttcttcttttccatttttaccggcagccagtctgctcctgaccagaccagatctcagcctagatcccattcctctttgtactgcatattcccctaaagacatcctaaaagagaatgatagacccagtgaatgcttagtagccacaggtagtttttttgtttgtttgtttaaatagggcctgtccaaagaaatatcacttaaaaaaaataaagcattctacctagttttttttttaatgtagccatatccaaataaagtgtatgatcccttccccacctatctcctccctttcatgttttcttggtttctgcttttctaccacagaaaactccagtgtctttgtgctacgtagaacacaagggatgggtgaatcaaagttgctcagaaatataagctaaggaaaagaagaagtgaattgaacttcaaaactaatagcacaaaagtaatgcacttgatatttgccatggacaggatactgtaaatcagtgcgtgtgctaattggccatttgcctgtgtatccttaaatccatttccctcccttcctctactctgctgtcaatcacaggaaacaccatttgggggctcccttgacaactagcttctagtagttttgacaatcacgggtactagcagaaaactgtaggatgaggaaaggggagaagtcaccgtatttctccctctgccttggggaggcatttccagcaggaagaagctgtgtcttctgtggctccactcccagtagacatccctttccttcatggtcccagcttctgccaggcagccactaggctccacttgttccagcctgagtaactggtttctggaaataccacatcctagaagcagtggcttcctgttcttatatatctttgaattgcctcctctgtccctgattagcttttcaggtcatttatcatctatgtaaccaattccaagtattaaattttctctgtttaaagcacttagagtagtttttatttcctgtgtagatcctgactgatacactggtgatttgaatctattctgctcaatgaattagtagaatgggaaagttaatgtatttaaacagctatgtctctgtgcggctctgaataaaaacaaaaatgcataaataatgtactaagacatttcatcacagcaaaacactgctttggtttctgatatttcatgccatttgcaaatatctccttatttgttattctggggagttttcattagggctaaactatttcacatgacaagtacttttacagcagtttgcaaaaatcatgcactttcccaggttaaaaagaataaccctgaactaaattttaccttcaccttgtgcttcctgacataagtctcatttctaaccaacagaccttcccagcaccctggtgtaaaggaatctacctggcccacaggacaaacgtgccctgaccagctttccacaatccccttctgagctgaaaaaaaatgtattaagtggttaaagaataaaacttggtaattcttataagaattcagacaatgaatggcttataaaatgggccgttaaaataattcatgtctgaaattcagcattaatatgatgcaacatgtcaggtgggggaactgactcctcagagctctactcctaactgcttggctacttgagtaatattaagagaatccatctgaaagaaagggaatagaaatactgacttgttctaagggtagcttaaataagctttgcaaatagcaagatcccactacaagcagatgaactgggcattcagatacctaatgagttagaaagcaattcttccttgatacccagcaccccttcatgcatctagtttttgtccataccaaacttgggaagtagggatcaacaatcgtccttacattctccctgagaggtgggaggagggctccagttctgctctcgtaatccattttttattcagcgtcaccttctctttcaatgggctaagtatcctacaaactggggatgcatcttaattaattctggccaggttcaatggcatttaagagcaggattggcaagtggccttgaaaatgtgctcagtacagccaagttgtacccttgaggacctctatacttaagatgtacctgtgtttctgctccccatcaactgggatccatagatctctctttgtaatcaagacccatactttactgaggttctgagcagctgctcaacgtgaccacatttcatctgccattactttttagtgtcttttaatatgaaggaatgcattcattctgtaagaaaaatgggattagaattttaggaaggctctcaaataatgcaacaataaattcttcaatacccagttgtcagatgtttcagtaaattgcaaatatcagattactttttaaaaatatttcaaacacacacttggaattaaacaagaaccatatattagaaaaggaaataagcttaccttttctattgtaagactccaagcacccacatggatcttcatggtggagattttaacaacactgctaatactgacttacttccaatcagagctgagagagcaaacaaagacaaactctctatggatgtactcatttttttaaacccatatttaaaattaataattttcttaggcattcaatgtgaataataaagctgaactcatttatttaaagttgtaaatttttaaaatagctctaaattagttctctgtgatacaggaaaccagcatgcagaaagccagtaactgcctcactgtttcatccctaactgtgggatcttgggcaagttacttaattgtacttgtgtccattttctctggaaagtgcatatgataacagggctcaccttggttggttattatgaatattaaagtagatgattcatttgattattattcaataaatatgcattgagagtctcctgtgtaacatacatggagcttgccctgttgaacttatggtttggaaaaagaaatagaaattaatcaaagaataatataaataagtgtaattatagctagataaaagctactaaaggaagatatttgatgctctaagaatacatgacaggagactgcacttaatctgtgatgataaaggttaggaaaggttccctaaagaaatacaaaggagatatgaaagattggtaagagttaaccaggctgtgtgcgtatgtgtgtgtgtgtgtgtgtctctgtgtgtatgtgtgtgtaggggctggagtggacatttcaggcaaagggaatagctggcatatatacccaggtttcctctggaaattcaccaccctgaggcaaccactgttagcctcccttccagttatgtttatcttttattttcagctaaataaattttattttgattcaaaagtctggggaattactttgacattaggtgtgtgtgtggtggagggtcctctgatgatgtgcctgtattttttccagagagcccagggcaagtgtgtatgatgcagatttatcctggacatacatcatgggcacatattatcattcattcagaaaatatttatatatttatcaggcacctgcttcatgccttgcattaccctaaacactgaggataaagatgaataagacacaggctctgtctaggactttaaccctcagttgagtgagggaaagagataagaagacacatatttgtattatgccacatcagagttgtgtatgtgaggtaataaattcttgtagcatggaaaatggcctggctgcctctacctgggagggccatgaagactacacagaggaggtcatatgtgagcagaatttaaaggaagcctaagaaggacgttccagaagaacatgtactagggcacctcatctatgtccctaggacctagaagaagagtgcctggcatgtcatacctcaataataaatatctatctaatttacaattggcacggaaagaagttctgtgagttattctgagtggatcaaacatagcatgcaagtaaagggtcaacctgcagagaagtggccagaaatgtaaagagagataaaattgtgaagatgttcttatgtaaggtgaagaatcccagatttgattccctagtttaagtgatggaaagcaactgaagccttttaatcaaggagaatgacataatcagctttgctttatagaaaactcactgtgtcagcagtttaggggatggaaaagtgggagaaaagacttaagccagagagatcgtcaagaagagattatacttgtccagaacagagatgatgaggtttggagggaaggaagatggaaagaatgcatttcagaaacattttgaagtaaaatccatcaagaatacatgggattaaggaagaacaaagagacggggtgatgaagaaatgtttctggcctacatgactgctgacaccattcattgagatgggaatacagaaatgagaaaagggttgagaaaatgcaagatcactttggggcatggtatggataaggtgcatgggtgtatgcatgagggaactgtcctgatggagagaccactgggcgtcttatacagatttgggaatcataaaattgcttcccaggagaaaacagagaagagaaggcacccagaaagcatttggagcccctgaccctggctctatcaccgcccactcctcttcacctcagacttcctggtcactccttcctactcactgagggccctgtggactggctcacatttccccactgcccaaattcctgctcttgctcagccgttctcccttgacaaactagctatcatatcaggtattgaccttttcaggacaagaaaaccagaataaatgccaagagacatcttgccttctctagcatagcatttggggacgcagaggagaggatgtgtgccttacataacttggaatggtggggagtgaaaaatcttacagagaagccaaagactattttatacaaatccacttttaaaaggggaattcttttccacatacaaagaaccagaaatactcattttgtcctccttttttttttgtttaatgtatatgcactcacagttgctaagaattaatactgaaaacatgattttttctaaataactccttgagaaggcacttaaagcctccatttgttatccaaatgtaacatgaggacaagaacagaagaattatttcataaagaaaataatcaatgaatcatttatcagttttcctaccctttgtatgacaaattgtaattagtatgatgtctttgttggcaagtgcttatcaaacaaaatgcagtacagaagcaaaggaagattctgtaaagaactgtgttgttttgaagacctaattgtgatgttatctctggaattttctgtgattacattgttaatttttaatctggtatccttaatagcaacaaggttattagcacctacctagagttctgaatgcccacattagataacacaatcttggcatggtgaacccttggaaataagcatttgcctaagatagaaaagagattcagaaagctctgatggccttggacagggcagaattttgagaaattgaatgtggcagaataaaaagaggttttatcaagcatctttctaaagtgctttcataaattttctctttggtaaagaatgtaccacacccgatcaagagtgttagaattgcttctcagacactttatctgaaattctttactctactttccccaaagtttgttttcactccaataattaatttttgagtgcctactccttgtgatacttgttggaaaatcaaagataaatgggacccagtctctgctttcaaagcactcacactggcatctagtgggaacacaggcctgtaaacaaatggtttcagtatgatgtaagaagcatactgatgtggcgatcataggaacagggatggcagaggagggagacctactcatttgaaataagccacctactcattaatagaatctctgaggattactacgattcccacagagcccatcacaagtagcatgagaaagaccccagggtggaagggggcccttgtgctgccccttctccccttatttagtcagcatggagcccctggactggctttgaacatggctctgaacagggcttaggggataactttcagtgactgctgaaatccagtcatatgactatgtgattttagtcatggctcgtggaaataaatatgctttttttaggagtataaacgtaaaaaatactaacaaaaaatgaagctatttctacatatccagaactattttttttagagacatagcagtctcatcagtcaatattacaaatatgacattcttttatttccatctgcaaaattgttcatgaataaacagaaaagaagaatacacctcatctacccaactctttaaaggttatagcctgctcttagaaacatgtttgtcccttatctcaatacctatattgactttcaataccttctaaagaaccaaaggtctctaataccctcttgttcctctgttttcagaggatgtgtgttaacaaatttaactgtgtaataagttattcttaattacattcggatattttctcctcctaaaggaaaactaaataacaatagataaatagatggatggatgaatggatgcatagattagctagctagctagctaggtgatagaatagatagatgtagatagataaatacatagacaatagataaagctgctcctttgggctctttaacctctttgatcatctttcaataaactatgttaccacttaattagcctgaatgagtacctattgcaatgctgattcttgattttatttatgtgaccactcaacagatatgtctagatatataagagaatataatacaccattcctcatctgtctacagcctttccaaggaggtaattgatcatagtatagatagtgttgcactgtatcccacatcctgttttccctattattagcattttacattaatatttttcatttgtcacattgatacattacattattattaaccaaagttcaaatttcattgaaattgtcttagtttttcaaaaaaaggagagctgttttgccaggtatgtcctgcagaccctggccgagcaatggatgaaaggggtactcagacacaggtatacagtgtaagagcagctaggggactgctgaagagtgaacagtctcgataagctggggctccttgcttttgtttagtacagacataatgccgaaagcctgaagccaacacaatctgtgggtaattaacattattgttcctcctttcagggagcagtcttgtgctggcatggtcaaaggtcagttcctggttaacataagtaaacaagcctgtttacgctaaattcccctacacttccttgtacctactccttgccctctgcctcagggtaagagaacagctgccctcagcttattctcccccaaagctatgcagagccttctgacctttcagaaggtttgcaccctttccctgtaatttctcccaccactctgactgatctcctgcaatgtttaactggtgttatattctaagcttaatcgattgcacacttaaaatgttcagaaaacactcaggatagtggacaagaatcatttcaagtccctgaaacctcaaagtctttagcatatactaaccttcaggtctacatactgatgtgtaattttcaatgcactgtcaataactatcaataacatcatacacacgcacacacacacacacacggccattttggatttgatttttacattgcagttacatatataaaagtgaagttatagattttaaacatttgcatatttcttaaactttctttttaaggatatatagatttgatctctcttttaccctccccaccaaataatggcccacttgacttagggcaatgggggtgtcctgtagttgtttattatgaagaagttgttctcaggcctggagacatgattagaaccagctggggaaattgcttttgagtagcagtgactgagttttactcaggggatgcagctttaattgatctgtgcagtcccctcatcccatctttttataagctccccaggtgactataatgcgcggccaaggctgggaaccactgcattggaaaatgcagaatttatctctttaattcagacaaacatatgaaatgtggaccttgtgtattaacatgaagcctggaagactgctagaaaactcttcgacctcctgctttagctttgtttcccctttgcactcaagcagaattaattacttcctacctaataacgtagtcatgcctcttttattttacttatcatgtagaattataattattttttcagtgcctgtctctccagttagacagttggtttccgaggccgagatcatgtcttgtttatgtgaaatagcctcagcttttaacacaattctggcacatagtagttgctcaataggtatcctagaaagggaaggtgagcataaatcagaaaaaagatataaagtgtagtttagtattaactgaaaataatttcttcttggataagcactcacttctaactacaggaaatgtaatgtagacaaatttgtattttcttgtattctgatcttcgtcagaaataatggcagctatcaatttttttatttaaagaatttaacccagcatctcatttcgggaaataaagcaacatatattgaggtagggattgctaacaagtgaatggctagttctgttaagccataataaaattgaaataatatcagcctgggacttttctctacatttcctatgtcagaacatttgcagtaactgttgctatcaatggatcatactcttgaccagctgggattgtctgagtttccacacacaaagagatggatgggatgctattagttagtctctttagacctgaattcaattttgattgaacatgtttatacttgtgagcttataattatccttgagttcattttaagagatggttttaaagatttcttttttcccttctcactaactactgctgtgttttcagagagatttactagcataaaagatttctggggacattcataaaagggaagaaaatccatagtttagtctgagtctaaaagcataaaccagaggggatgccaggcatctttctactgagtagcttccccgttgatcaatgttaggaagcttgctaatgacactctcatccagaacttttggagagtagggagaaactaacaaaataacagagagccgaggaattccacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctacagccacctataacttaagattctcccccacacagcccagacatacacacaacgctaagatctgaatgcctgtgcccccaaaaattcataagttgaaatcctaacccccaaggtgatgtgaaaaatgtaccaaaccctgtccagaattttggaatcgcctcccagatactttatctagagactctttgttctacttccccacaagtttttcattccagtatttaatcattgagtgtttctgcttgtgatacttgttgcaaagtcaatgatagtcaaagaagttcaaaaattggttactttggacttaacaagcaaatgcacttctaggtggcttttgaaaaccaaaagtacacctaagtagagagcttctgttttttatagtgattatatgaagagtaatgggtgaaaagcatcaaagctggaattggagctctggggtctacaccgtttccaatgaatcattcctaatgtgatgctttcatccatgctcttggctctgtctgggatgtctcctctccgccaggccctgatttcagtcatccaggccgagtttaattatgtataactgtcttcgtttatttggggcactaaaacaaaaataacaaaaatactatagactgggtgtcctaaacaccaaaagtttattactcacagttctgcaggccgggaataccaagattaggttatctgcagattctctggtgaggacctgcttcttagttcacagacagcatcttcttgctgtgcccttccatggtataaggggtaagagagctccctgagatctcttttagaagggcactaatcctattcatgagggctccactctcacagcctaatgacctcccaaagggcccagctccaaacaccatcacgacaacatatgaatttgtgggagatataaacattcagcctatagccataaccagatgtttttgcaaccaagatggtgaattcttcctgagcacgtgccagtcagactccaggagagcagggatcccatgcacttatgtacttccatccatctcacagcctccatcgctttcagaaggttgagctgcccccaggtaccaaagcaaggactggaatatagctgagagatagaaatgttttgcaaaatgttgcttacagattcagaacttaaactgatttcgatctcttgggaaagaaatatgaattctaatctgatttcaatctctctggaacaaaaaaccttttgtatctatctttcttcaatgatgggaaaaagtaaaataccttccaagcctccactaatccttctactgatgtcttctatattcgtgattcagatgtgccttgtagacaagcacagatcttcactgctcacttctgccataaatgcttcacaaattaaaaaaaaaaaaatggtaagcctccgttagacagaaagaaaatgattcttttcactgtgtttaagaggactgattagggcatttcttcagtagtaccaatgtctaccatatgcttcttcctaaacttatataaaaataaatttctgacaaaaatatgtaaaatctaaacatgtctaactaattctcactgcatttctatgcttttcatggaaagagaaaataacgatgaaacttaagagtattgaaatatttatttttcaaaagtaatctactttattaatattatttgcttcttttttcatggttgtaggttcattgcattgcttttttcttacagacattttgataattgttgattttcataagtttgatagaagaatgccattaatacttctcatttatttttcattatctgttcacattaaaataaattctctcttgtaattttcttatgtatacaaataattggaatatttatgtaagattttgtgttttttttttagttttagagtatgaggttattataagggaactgttgtagattaaacttttttaattatactttaagttctgggatacatatgcagaacgtgcaggtttgttacctaagtatacatgtggcatggtggttttctgcacccatccacccattatctaggttttaagccccacatgcattaggtatttgtcccaatgctctccctccccttgccccccaccctccgacaggccccagtgtgtgatgttccccgtgtccatgtgttcttattgttcaactcccccttatgagtgagaacatgcggtgtttggttttctgttcctgtgagattaaatatttcatgatgaaaggagcaaagtgctgtgtctacatgtgaaaaatcaagtttaattcaatctagatggatgaaatacctggaatatccaagtaattctagtaaaattcgttgtttgattattttattcctcccactaccgtatcgtgtgtgtgtgtgtgtgtgtgtgtgtgtgtgtgtgtgtgtgtgtgtaatgttgctcagaaaatatagataaatacttccattctccatcacaatttattgttttgggtgatgcatatcaatgaggttatgattattcacacacaattttcagaatatacaattttatatcctatgtgctgtgtttgttctctgcagctgggaaactgacctggtgagaagaaaaataggtagcccttaaaatctattttagaacaaaagttattttaagatagatgttacggactgaatgtttgtgtacccttaacattcttatattaaaatcttgcctccctactgtggtagtatcaggaagtgaggcctttgggaggtaattaggattggaagagttcatgagcgtggggtcctcacgattgggattagtgcctctagagtcatgagagagcttgcttcccctctctgctctccaccatgtgaggatacaataagagtcacagtctatacacagaagagggctctcaccaggactcaaccatgtaggcaccgtcatctcagacttccagcctccagaactgtggaaaatgagtttctgttgtttctaagtcacccagtttatggtattttattatagcaacccaaattgactaagaaagttagactagtctggaaatgggaccgccttcacctttcccaagtgaaaagtcaaatttcaaccccacccctattattcactccatccagccttcactgagtacttacattgtgctggggactagggacacaagaactgataagacaggaccctgctcattgtcctctgctcattcccctccaaaaaagtctaggatctgaatgcatgccagtctccacctcatccagtgtataaatctattccaaccctgtggttatgtcactgtgctgagagtgcattgtgctatgtcttgaagacgtctgtcttgtacgttttaaaacatgtcaaggttattataaaataaatgcatcaaagcaatacttttgccagctttcaacttatgaatatggattggctttaataactagattaggacactacttcagaagccatttatctaatgtatttttccaaatgttatttcatcaaaaaatttcctggaaatgaacaagatatattgaggccaagatgccacctaaaaaatattcccttttggtggggcatggtcactcacgcctgtaatcccaacagtttgggaggctgaggtgggtggatggctttagcccagagtttgagaccagcctgggcaacatggtgaggtaagactccatctctacaaaaataaataaataaatacaaaaattagccaggcatggtggtgcttgcctgtagtcccagatactcaggaggctaaggtgaaaggatcatttgacctgggaagtggaggtttacagtgagctgagatcatgccactgcactccagtcagggctatagagcaagattctgtcaaaaacaaagaaggaaggaaggaaggaagaaaggaaggaaagtattctatttcaggaaaatagcaaactaaatttcactaatttttgttatttttgctctttattttctagtattttttggaatgtaactggataagttaaatgaaatgagtaatgtaatttgatggaagtatgtagttattttcagatgaataaaggaattaggacttgggtcttggtttccaaaaagagaaaattaaagggtaaaactacataaatcattagctccggaagtaaaggaatttatttttcaaagttgaaagagaggattaaagaagaggaaattaaattgaaggataaagaaagaaaatttaaacctatagaactcctaccaagtgctggcctgaagctaaattccaagttctatgctgtatttcattaaccctcacaacaacctaatgaggtagggataataattcgcatttacaaggagtaaacaaccagtcagtggccaagccagggttcaaaggtagatttcctgaaggaaaccatttggaatcagcgatctagagactaagaagggggaagaagccttttgcactggaatgagtaaggaatgggaaaggagataaagagactagcacaggcagtgctgaacatgaccagttgagagcaaggaaaggagagatttcaaagcagttaagaggaagtcctgctagaagtagacagagcaaaatccaatactgggtcctggatggcgaggaaggtatccttctaaccaaatgaatgaaaacgtagcaaatgcagacaagttcaaggaaggaggggaagactgggaggaagacatttagagactctgaaatagtctctaattgctttgcaaagtaagggatgagatcaccatgtgagtgagggaggatgttaatgggacttcaagaataaagaaaaagatttgacaaaactgagaggcctaactacagacagcttggttaaggattgcatgtacacataggaatgagtttcagtgtgcaagtctgacagggtaggttcacctgagttacgaatggggaatgtgtcagtggggaggcagaactggtgatgtggagagaggagaaaagggtcaagaacgtgtgttcatgcgcgcacgtgtgtgtgtgcgtgtgcatgtgcgtgtgcctgtgcatgtagaagaagatcataagtgagtgtgggtgggtgaaaaaagtgtttaagtggatcagtctaaggagggaccaggaaggggaatggggaataggagcaggaaaggcagaaaagtaagcttgagaactcccaaaccgttttgtttgtaatttgttagtacagtataataatactaaataatagatttgtaattctaagttgtaagacaaagaaaatatgctcgttaaaaaaaaatcttaaatttgatagcaagttagggattgatttctgaaaaacagcccccaaagcacaaacagtaagagaaaagatggatgcatttgattacttttactaatttatttttaattttattaattaataaattaatgtattggttttttaatttaaccaatttgattaattgattaattttaagttaaaatgcaatgtttctgagataaaaagcaaacacacaagccacagtaggaggaaataattataacacatacaaacaagagtagcataaagcacacctaaaaaaaaaattaaagaaaagacaaacgatccattgcaaaaaaatatgcaataacctgaagaggcatttcacagaagaagaaacatgaatagctaataaacatctgaaaagattatcaacctcattagtaatcagagcaatgcaaattcaaagcaaaattaaatatcactttacactcaccagattggcaaaaattttagtctgaaaatataagtactactgaagacgaagagcagcaggagctcttatatgctgtcgataggagtataaattggtcccaatcccttggaaaacaatttggaattaccttgtagttgaacatttgcttacctttctacctaacaattctactcctagatatttccctagagaagcactagtacaggtgtgtgaatgtttacagaggtaatgtttgcaaaaggaaaaggaaaactggaatcatctcaaatatccattgacagaagggtggctaaataaattgttatgaatgcataaatggattttactatggtagtaaaaaaatgaatgaactgcagccataagcattaacagagatggatctcacaaacaaaatattgaatgaaaaagacaaatcacaggaatacatacaaaatgatgccgtttatgtaaaggtgaaaaactcacaaaaccaaatattttgttcatggacacgtacatgcacagtaaaatgacgttgaaaaatattgaataatccaaaaactaaaataacagttactcctgccagggagaaagaggattggaatgtgtctgaatggacaatgctctgtctgttttatttactcatttttaaatttttttagagatgaagtctcactctgtcacccaggctagagtgcagtggcacaatcacagctcactacagcctggaactcctgagctcaggcagtccttccacctcagtcccctgattagctgggactacaggcacagctaatgctctatttcttaagcttggtcgtttattattctatgggcctatgaacacattacctatagtccttcatatatatgaaatatttcataataaatgcaaatcaaggcaaaaattaaaaggggaatgaaaagccaagtatatagaagaaaatttggtgttggtctaaaacataacacatttagtttaaatatataaatcttgtgaccttcactctgaactacatacagaattggctgggccttgcaaagtcgcagtcctttgaaagaatggttgaatatttgaaaaatgggaaaaaaaataaagttagtgtttcatttttaataggtaagaagtactttattataatgaatctgtcagtttaacctctgtacataaagaacacaagattaccaaaacaatgcagttatctctagaatatgttctgtgaaacaccagacgttaaaggttctgtaatcaaatgtgttcaggaatgcaagatactataccccctcttagaaattcgtaagtaagcacctaatatggctgctagattattttttccatcttgaaaattcaaatattaatgaaaacttaagtattctctatgagagatgtagagaatctataaatgaaatctcttgcaaggtctaagaaaatcctgcctcaaatgacatctctgacaatgttcatctcattctttggctcttttccctctgctcacacctcaaatgttagtgttccttaggctcattcctgttcctcttctcttctcaatctctttgcctcctctgcaatctataatctgatcatttcaagatctctctattcagacctcacttttccagactcatactctaaattcatattggaatttctcaagctatgatcccacagacatttcagatttaacacatccaaaccagactctgttacttcacatcctaaaataacttggtctctggattctccattttcatcatggtgtcaccatcccgtcttgttttcaaattagaaatcactttaattggactcttgcatcttcttgcatttattttgccatttttcaggagtgttccttggcttgaggattagagatctttattttctctaatcctttgtcacatcttagtttccagctttattttgtcttaattgggtcattctgtcaccaatatttcccatatgcagttcataattcacatagtattaacataagcatctaatcatgttatttcttgttaacatgaaataacatgttctgttatttttcctgtatggagagcctccagagactctatacaggtgatagacagcctgttaaggtgatagacagtacaacgtgttaggttatacatggagggccaacagatttttggtagtttagaaaaggaagtgaccatcagatgttgatagaagatgatatttctgagtattaacgtatgagtaggagtttgcttgttggatgaagagggacagagacagctacggagtcttgacaatttctctttgtctctgcttctgaactagtggtgaattgactacagaaagtcttgattatcataagggccagtactgtcataaccctaaactttgtgtacaatagaaaaagatgattctgcaaaagaaactatcatcagagcaaacagacaacctacaaaatgggagaaattttttgcaatctttctatctgacaaaggtctaatatccagagtctacaaggaacttaaacaaatttacaagaaaaaaaaacaaacaaccccattaaaaagtgagcaaagggctgggcacagtggctcactcctgtaatctcagcactttcagaggccaaggcgggtggatcacctgaagtcaggagttcaagaccagcctggccaacatggcgaaaccccgttactactaaaaatacaaaagttagctgggtgtggtgatggacgcctgtaattccagctacttaggaggctgaggcaggagaatcacttgaacccaagtggcagaggttgcagtgagccgagattgtgccactgcactccatcctgggtaatagagggagactccataaaaaaaaaaaaaaaaaaaaaaaaaaaaggatgggcaaaggacatgaacagacatttctcaaaagaagacttttatgtggccaaaaaccatgtaaaaaacagttcaacatcactgatcattaagagaaatgcaaattaaaaccacaatgagataccactatctcatgccagtcagagtggcaattattaaaacatcaagaaacaacagatgctagtgaggctgtggagaaataggaacgcttttacactcttgttgggaatgtaacttagttcaaccattgtggaagacagtggggtgattcctcaaagacctagaaccagaaaagccatttgacccagcaatcccattactgggtatatacccaaataaatataaattattctttataaagatagaggcatgcatatgttcattgcagcaccattcacaatagcaaagacatgaagtcaactcaaatgcccatcaatgacagactggataaagaatatatggtacatatacaacatggaatagtatgaagccataacaaggaatgagatcatgtcccttgcagggacatgaatggagctggaagccattatcctcagcaaactaatgcaggaacagaaaagcaaataccacatgttctcacttataagtgggagctgaacaatgaggacatggacacagggagggaaacaacccatactgggtcctgtcagagggtggagggggaggagggagagcatcagcagaaatagctaacacatgctgggcttaatacctaggtgatgggttagtaggtatagtaaacccccatggcacacatttacctatgtaacaaacctgcatgtcctgcacatgtaccccagagcttaaaataaaatgaaaagagtgaaaaaaaaaagaaaaaaagaaaaggaggtccttctaggtgaggtattactaaaaggcaactgaaagaaaaaaatgtttctctatacttaacaacaattctggacaccaaatgtgtgggtttttttttttttttttcatgccgaccgattctccaacaccagctgggtctcctacaacccaccacagttctgacactagctacccagagttagcatagaccacacaggtaaaggcctcagtcccataagactgccctacacttcaaatgccagttgcagacctgggcctctcataatttctgaccaaccaacaataaatcaggggtgcttactacttcctccttgggttggataatttgctagaatggctcacagcacttaggaaagcagtttattcaccattgctggtttactataaaggatacaactcaggaacagccaaatggaagagatccaagggcaaaggatgtgagaacgggagctgtatgccctctccgggtccaccacccttccaaaactttcacatgttcaccaacccagaagttcttggaacaccattgtttagaggttttatggtggttccattatgtaggtagaatttattaaattaatggccattgatggttgagctcaatcttgagcttctctcctatccccttacactggggatgaggctgaaagttccaatactgtaatcatataattggttcccctggcaactagccctatcctgaagctgtctagggagcccatccactaggcattcatattactctggagattccaagggtcttcgaagtgcttgtatcagaaactagggactaaggccaaatattgtaacaaaagatgttcctatcgtccctatcactcaggaaattacaagaattttaggacctctctgccggggatttgggacaaagatcaaatgtttatttcttagtacatcacaatatcatagtatttcttcctctgggttgatggagacagaaccaaagtgcaagtcttatacaaacaggatttcaggccacacacacttccagtctctacccaccccgtagcccagtacctgtgtgtaggggacacgctacacagccataatctgcagctctgattctgactcagcagtcctgtacattatatggccccatgattgccccaaccaaatgtagcatttgcagctcttatcttttgcagctatactatctttggcagccagcctgctgctaggtgacagtttcttttaaactactgagatgagccaatcagtccacacaaacggaagttttcataggcctgtgacagactccaactaaaatgtggttttctacccaaagctttagtgtcctgcctcatatgaagtacaatttcattacaaaatagcaagtgcttcccaagccaatgaggtatctctaagtacatggacctgaggcatgaacatgctgatgtgaatgtaaacaacagtcacacataaaataaattagtcagtgtgcaatgaatttagaaaatacttcaaataaatagaggagactaaatggtatttattcatttaatcaacaaatatttattgagcctctattatatgacaagtattaccctagatactgggaaaacagagattaaccaaataaacaacactcatgaaatttgcagtctaacgggaggagaaagacaacaaatttaaaaatctctactatgttgagtggtgataaatgttgtggataaaagtaaagttggatgagaagactagggaatgccctggtgaggcatgagggcatttgatacttgatataggatcgtcaagagagaaccctctcagaaggagctgttgtcaggggaagatcaaaagccctgagctggaaatgtgtgtgtgtgtgtgtgtgtgtgtgtgtgtgtgtgtgtgtgtgtgtgtacctggcccacttctttttccttcagtgtttgtctttttataacctgtttaaaagagcaatttttatattaaaaaattaaccctttgaattccgtttatgttaccaacgttttcccctcacttcgtcagtgtatttctcttttgtgatatttttgcaccagtggaatttttatcagaattgcactcaaatatattaattatttgggaagaatttacatgtctgcagccttcagtcctcccatttagtaaaactggtggtccagtcttaaaagtaccacaaatttttattaagatgattctttggtttttaaaactatttttgctgttattatgaatgtaggattattttggtccattgtactttctaactgttgtttctggttataagagaaaattattagtttttggagcacagtggctcacacctgtaatcccagcacttgagaaaactatttgtttttaaatgtgtatgtttttgtcttcagccattttctcaaactcccttattcgaatagtttttagtttctttccactatttataaacaattatttcatctaggtataatatttctgtttcttctcatcattaacattttatgtcttaattctactcactaaaatttccaggaccttaatgaaaaaaagataacagtatactcacttttcttgttcttgattttaataacatatatcgctagtatttttacaattacttgtgatgccagcctttagtttaacagaggtgttttttattaggtgttaaagaaatatccctttagtcatagatttaaacattcttatttggagtggatattgcattttgtcaaattctttttggtatctgtcaaagaaatgataagttgtttcttctttaaatggctaataccataaattaatttaatatagggtctattaagatgttttttagagaacactttttccacaggctggtccatgaaaaaaattgggggtggggagattattgtctgatcaaatcatttggaggaaatgctacatagtatattttcttcttaaagattaattagctcattagcatattaaagatactgagaagtccagtagtgaagaattccattaactttgttaaacccttcatttccaaatattacctgtcccccctccttcatatagcattaattagcaccccccttgacttgggttcaatctaacacacttgagaagtgttatattaatagctttccttgtattaaatcatccttgcactcctggaatagaaacgccttggccatagagtgtggctttttaatctagtgctaagagtgctaagttggttaggttttaactgaggatttttgagtctgtaattataagtgggatgtactgtcatttttttgtctctgccttcttttggctgtttctcttattttagtatcagtgtgattctggattggtgatatgtattgggaaatgatccatatttttctgggctctggaacaatttatgctgcatggggaattatcataggattttattttcttaatttgaaatattttctacaaaatagccaaaagagaaatgaacccaaacacagtgctaactggttgtcagtgagcttgtaattaaatcccctgttagctttattttctttactgatgaggcttcaaatgtcttcatttttcctctttgtgggtaaacatgattgctctttgccccaaacggttgacggttcagacagcctaccctgcttagaagcaatcattccttgctcttgtcactccagttcactgcagaacagggaagcatcaaagttaggtcagggaagcaggaaatgatagaatcccaggcaggagaaccaaacttctccatgagtatgttgtccctgaggctgggaacaaagtggggtgacaagtatgaaggcctggagggagggaggcaacagaggcaggtgaattgtgaggtctagaatcccaagaagaggtgaaagagtatcgatcctgttttaaaaacactttctttgaggccgtgttgagagaatgttggacatttacagtctgtaagtggcgacagggagtgctaggtccacttctgaggccagttcctccccaagtcacagaactctttattcagagagatgcaatattattatagtcaaaatacttcacacaattaagggtttaggcatgaaaacacataaaaatggatatataccttctttcctggtatggggattactccacattaaaaagcgaaataccttagccatgcattccagcctcatagcaggcgcccagctacgtgctaggtatttgtgactaagtacctggtgtttgttcaataaagatgtgtgttgtctttccttgtttttatgcaatagatgtgtttctaaaaggtggggcatacattaaaattagagaattaatctttttttccaggtgaggtatatatatatatatacacacacacatatatccttaggcactaaatgtgtctgctttttaatccatctttagttagtgtttctgagcatgggaactttttaacctctccttatcctggtactcttaaggtataataatggtctcagatacttcaatatattaaattttaaaaattattatattaatattcaaaataatttttttctaaataagttgataagttgccagtgttctctatttgtttcttcatatgctgggtagcttgcacctccatctaaaatacaaattgcacataatacaattctttaaccaaatatcggttgtgtttcttttgagacaaaaaaagaaactgctaagattacatgtctctgagttattctctgtaatgtgatgaatgccaaaaacaagaaacatgtatagtagaggaaaatagtggtgatcaacagcaaagtggttccctccactcttctccatacccctctcctcccttcagagaagcacattcatctaagtgaattgttgggaaaaacttatagtccattcctccatccaaggatccctctacgttgcaggcatatgtttaacatgcttattaaatgctattttttctctagtaatgtacagcaaaaaataataataatcaaaggaaaattttggtggtctgttgcaatatgaaatcaggatttgaatgcctgtaatattataaccaacactgagttctttgaagttccttgattctcacaaagctaaaaatcattccttacccttgattagagaaaaatctgattttcctgttgcattgccttcttgaaagagatgatatgagaaagtgccacgatgaattgttgaggttaaatcagacgatattgattttgtgtctaacccagctgtactttctcagttccaacacctcacagggaaatacatacaggccattccacagtaaagacacctgcgacttgataaaattattgggtaaggacatgggaaaacatatttttctccatagccatgcttgcatgtttttctttttttatttttattttacccctttccctgcctcccctttttgtgattgtatagaatatgccaacattttgaagggacatcttgggaggtgaggccggttccctgggaccagattctctgttatcgtgagccaggtcaccatttcattcccctctgttaacagtgactgtagagtccacagatgttccacagtgggtggaggtaataatctgaggcctgtacccaagccaccttgtggcccaggttttaaagttgtgtgggaagcaaagaaacagatgcaaaagacaacatgcagaaagagtgaacacaactcagtgactaatggggcatgcaggatcaggaagagctaaaagtcaaatgacattcatatcctggagaatgaggtgcccccatcaagttaatccattaattaatcaaacattcaggacctggagccattcactctctaacatattctttggctgtattaatatggccattaattcctgaacaacaagcagaaggaaacagtacttaaaaccatggttgagagcacttagtttttcttctctgacgatgtgcaaatcggcagttgcacttttaaaaaaagcctttcatataaatctgggcaccatcctgaatgcatcagtcctattaacagcatgctagttttggagaattgctacaaacccagcctgaggtgaatggcagctgctcttctctggtcagggctacttaaagaagtggcaagtccaaagccatttagaaactgaaaagtggccttctgataaataaaacgacacttctgaagctgaacatcaaggaaagaactttgtgctgacggagaactacagaagctttcctatgggaggctggcatgcagatgtcaccgtggggctttgttgattatgaaactggaagccatagcagtaagtgggtgcatgggggcaaccaaaagcaggaggatggccttgcctgtgtctgtaagacgacttgagacagtagctgccaacagagtcccttaggtgtgtgctttataactgcaggatggtacaaatgacactcttaattttctgagagtttgctttgcagtgaagatttaagacactgagattaatttagttaaattgatatttcccctcgtgatttcagggattaaacagtaaataagcctcttgatgttgatctatctcctggggggtccaataaattacagaaacacttcttgccattttttggagcttcctcttcatttattctccttcctgtggcatactgtgtatggccaggcctttgctacaatttgttatttataaaaagtacagagcacatttcaatcctaccagataaagtcagaattctaactgagctatgggtcaactaactagaaaaaggagtttaagacccaactctggatgtaaatgatgacatggctgtctgtgagggatatggtttggatttgtatccctgcccaaatctcatgtcaaattgtaatccccagtgttggaggaggggcctggtgggaggtgaccggatcatggggacagacatcccccttgctgttctccggacagtgagtgagttctcacaagacctggttgtttaaaagtgtgtagcccctcttccttttctctcttcttcctgctctggccacgtaagacgtgcctccttcctctttgacttccgtcatgattgtgggtttcctgaggcctctccagcaatgcttcctgggtagcccatggaaccatgagccaactaaacctcttttctttgtggattggccagtctcaagtagttctttgtagcaatgtgagaatggactaatacagtaaggcttatggaacttcaagtggtgatttgggttggattcctgacatctccttggtatatccttagacacatcatggagtctctctgttacatcatcgttgagaaaacatcagcaaaatgcttaaaatgttttgggaaaaaatatgttggcagagtcttacttaggaacaggctgcattccaaaattattcaactaatttggacaaattgagtgtctactatgtgccagacatagttgacttcgatagatggggcacctttgccaaaaagtagccctttactggcaagtttccagttagtttgcaagtcagctgtgtataaattgggatacattttcctaaagagacaaattttgaaacagtggttagattctcaggccaattctcagaagctaagttaattcataatgaagtggaactcaacttctaatggaattctcaaacctaactaccatttacacagtgatttttaaccctttgctgcataccacattataacgacctaggaattctttaaaaatttaataaataccaaccaggtgcggtggctcacgcctgtaatcccagcactttgggaggccgaggcgggcagatcacgaggtcaggagatggagaccatcctggctaacacagtgaaaccccgcctctactaacaatacaaaaaattagccgggcgtggtggcgggcgcctgtagtcccagctactcggcaggctgaggcaggagaatggtgtgaacttgggagacggagcttgcagtgagcagagatggcgccactgcgctccagcctgggtgacagagcgagactccatctcaaaaaaaaaaaaaaaaaaaaaaaaaaaaaaaaaaaattaataaataccaatacgcaaactatgcccacaggacaataaaatcagaatctattaccggtagcaatggtggaaaatggaccttaggaaagaatagagaggaatgggaagcaatgcctctagggagatcagggctgtgactggggggtaggggctagggttccagggggtgcagggtgtcgtctggggtattgtggcattggtggctagaataacaagagaagatgcttctggaaatagtagtaagactgtgggcttgtaccctataggagatttttgtcttttgacagtaaatcatttttcaggagtacgaagatgatgcagggggctagaatattcagctccagaagcacaaggattggtgcttcaatgataaggagggagctgataagaacctaagtggtcaacatcactcatcagtttccttttgtccagttcatgaggaatgaaagaagctaccttcaatccaccttcttattttggggtgaagctttcacaaaatgccatgcctcatgtttctcctctgaatatgtagttctttttatcatcttggcctgattacaggcccttaagactcagcagagctaaggggaagggaagggaattgagggaaccaccaagagagctccaaaaacaagagttggcaggtaattctgttcatccacgcctgctctgtaacagctttcagagttcagctcttactttcagtcacttccttgcaacccttgcagtcagaatttcagggttcagaaacataggcctaaagtgttatcaccaagtggtgaaagcaagtttgctgggtggaggatctcctcggctattttgccaagttcttctcatttttatagctgggcatgaagatttccttttttgacattctgtgactgttacaatgtaggaaaatctgtggagatacaacattttcatatttcaagtagctgctctcaaataagggacattttctaagttctactgtttatttttccctggaattttctaggatatattgctttagctctgttttctagttttctctttatgacattttggcttctcccggtcaacaaaaatactgcactggaagaattccagagacatgtgaaagttatctgtcctgcttgagggaaagaaattactactgttttcttccctctgagagagatggcccttaaaagtgttggaatgtatctcttttcttgacattttctgatgttcctgattctgttttcctggtgagggcaaaataaattattgtgaaaaaaaggaggtgaggccctggttctacaggtttctagaggttctggtatggggagggtgtgcacagaagaacttcttccaggtactgatttactgtaagcaacaaacaaacagatcttttttctcatagattgccagccgaactgtgtagcaacactatggaaaagaccccaaccacttccacaaaagaaattcttcccttcactaagtgaggagtttaactcagttagaaaatctggatggacctcaaaggaagaattttctcctttcaaactcaacccatttcaataatagagagaaaaacagatttttttagaactgaaattccttagcaaaatttaattggaatagcattctaccttaatgggcaatcagcttatttagtaggtgagactccattaattttgactgttcaaggagatttcataaccaagtcacttaacttcaagtattctgatggagcagatagctccccatttaggaattttcttgtgctggagtaggaaaatgagagcagcgcctgccttgatatgttgatgatacccttttatttggcaaaggtattattcataaggtagtcaattaatgtcagcctattggaaaaatgacaggctttaaagcttcctctttagattagagactctaaaattctaaatgcctgcagatccatatgtcagttgttgcttctgacctttcctaattgaattagcctccttctagtgagcctgatttaaaaaaaaaattaatagatggggttgctgggggtatcacttagattttcctattgaaaataaatattcccctccaagtagtttatttccggaagtattaagccaaagtcagaaaagtggcaatagcttcaaatagacaggaagtggctgtaaaattagcctttcttaacgagaaggtcagagctgctttatatttttttaaatttcacttttatgtgtggctcattgcttaggctctggctgaggctcatttaacaatgatcccagcagtactggagccctaagcaacaagacttggagacctatcctccttccctggggtgaaatcacctcaaatcattcttaaatacttgttaaaattttcagttgcttaaaagttattttaaatgtaaattttcattttgaaagcaaacagggactcagaaatgatttttgtcagaataagtttgggtctgattctctcctataaccatttctaaaggaaaagcttggtttaattcaatctccagttaagtcaaaaacctaaagaaaagtgagtcatttcatttctcctctaaaaactaaagtgtcaggaaaagttcttttatctgtttcaatatattccaacctgttacaatctttttttttttaagtcataggaaagtatacgaagaaggaatggctgataggtgaactaaaagagaaagccaaaatctttaattacctttatcaggttagcagggaaacaggcacctatgccttaggtagaaaaaggtgattagcattcagaatactgaagcccacatcaattcagaaagggcatgattttaagataagttgaagggtaagttaggaagaagcaactttttaaagcttaagtataaaactaggatgagatcaaagatggattgttaataagagtcaaggattagttggaagtaaagtccctaatcatacccagagtatttaatagactcaattgtgttaaagaagatcttagaggtcatccaatccaacttcgatctttgattgcaaggaacagatgtctcctccagctgacactagccaaagatgggaatttatttaaaagttatataaactaagcactgaaagaaagccaggcctaaagaatgaaggagattccagaatttgatctttatttcaggacctatctctttatttctttgaaaattaatgcatatatcctcagcagcagcataaagctattgtttgtacatgactatggctgaagttctaaaatgtgttttgaatcgtgaaattacaagcacagatctacaaaatggtgatagtgtctctatactaaaaatacaactgcacattttcaatttctctaaaatgaactatgttactatgtaattgcaattacagaactgctgttaatgatgaaagaccctacgcctacctagaccaatcctcttattctaccattagagaaactgtagcctgggaagaagtgatatgttcataatttcccagaggtttaatagtagagccagtagaagaatggagatcctttgatggctgctgtatcagacatgatgctttgtgccacactgggagcagtggccaagaaagaacttagttaagaacctgagttctctagtgtcagactgtcctcgggcaagtactttatacctttctgagccttcatctgtgtaatatggatattagtactccccacaggatggggttgttgtgaggattaaatgagacaacaaatgcacagttattaacacaatgtctagtacatataaatgctctaaaaacaatacaattatcaatcgaaaaatattagctttttgctgcataacaaacaatcctgaaactgaatgatttgcaaaaatatttttatttcctacttataaatctgtgatcagctataactctgctaagcttagctggccgtggctccagttttgggctcatgttgatcccataagtttcctcatcccagatccaggctgaaggaacaacccctaccttggatgcgttgttctcacgataaagaggaatataagaaatgggaaccatgtgatgcttcttaaaacctctactggacaccatcacaatgttgactcttcgcatattatacctatcacagcaagtcatttggccaagcccaaattcaatgaggcagaaaagttaattgcatccacaggcaagctatgttctaggatggaatgaacaatataatctagcacagaaaggttgcgagaaaatctgtggtcactgacacaagaagcttgaataatctgaaactataaactgcataggccatctgtagtagctcaagtcttcaaaattatggactgttaagaaaaaaatcagagatctagggaaggcaacaaagttattttgggtacagacaggataagagggtatataataccattccttctcccagaagcttcaataggtagaggatatactgatttagaggtcatttatttcagtgtttccaaacctgaaaggtatttcaaagggttcatattcttaaagcagcagtggtatgtgtttgcatttccactaattttttaaaagctcaatacatttaacgtttatgtaaaaactgtttccattataaatggaacacatcgagaacccccaggtgtatatggaggaagcctacttggtggtaagtggagattagatgactttgctcgtgatttgtaacttagtttataacacagatgagcactactaggtgcatcctttatcatcatacatttttaattgttttattcttagtcatatgttgtttacatttcattctcaactctgaattaatgaggaatttaatgaaggagaaaaacataattctgtcaattttcttctggatacttttccccagatccataaatttctttcatctgagaaaataactatatgaaacatcaagatatctctaatatttcaaaacataatgtaaaaaagaaaaataaattggtgctatttatgcatcctgtctgtaaccaacaatctattgcagaaataaacactgatgatgctttgaggtctgtaccaggttaggggatagatcagaatgactgtgttcctattatttttacacctcagtacaacatcacaggccattccttctgcctgaaaagccctccttcttctccctcctctgcctaatgttccactcagccttaatccacagctcagctcttacctcctgttggagaagaaattatcctcttcaattccctcagctatatttgttgctctttccccagtattcccatagcacatgcaggggaattacctcctgaatagccttggttttgaaaatagtcactgagtctgtctttctgagttaaccctgagttgagattggggcaatttggttttccagtgcccagcaacatgcctcgcacctagaaagtactcaacacatctttcttgagtggatgagagtaaacggaattgcagcttgatatataagattgaaaactggagaggacattgaagagagcatttcaggaagaagaaaagcacacagaagtaaggagtaagaagacagaggctgagatgcgcaagtttaaggagcaataaatgagcccatgtgactagaccaaagagtttaagaaaagaagtcctggaaaaagcagtggggagtttaggtgtgttgaggagggtctcaggggacacacattgtcttggtctgccctggccatcgtatgtcaaaatatcacatagcttaaacagcagaagtttattttctcacagtttcgggagcttgaagtctaagatcagggtaccagcattacaggtttctggtgaaggctctcttcctgtcttgtagatggctgccctctggctgtgttttcacatggtgggaagagggagcactctggtgtctcttgcttttcttataaggaaactaatcttatccccgtaatctcatcatatgacaactcaccctgctaatctcatgtaaagctaattatctcccaaaggccccatcaccaaatacaaaataccaccagactggggactacggcctcaacatatgaatttgggggaacaaaattcagcccatagcatccacccatattgagtggttaaggaaccggccactgataaatgaagtggaccctaaagattgctatcatccttctgccattattggggttccattgttcagttaagaaagtgaatgaaatctagaaaatcagcatttccaattaaaaaggcgttaaagcctaaggacatgaagaaaataaccttttaatttctgagatgaatgaacaaagaaatttttctaagtggtatcttctatttctatagcagccataaatcataccattgggagctgtaccattttacttttaaatgtacgtttttgaaaagaacacagtcgtttcttattattctccttttgtacaatttcattgcattcataaccagtcaaagggtcctgatgattctccggcagaaaaactatttgttatattcacagtccaagtgcctactgattagcacaggtattttgcattagctgattgggatagaagtacagtcttcctctaagctttactgctttctccattttccattttttgttatttttcaggcctggattcctttcacttggttcattctcttaagaattaccagccacagaatgatgtttttatttatttgaaaagtttatgtccatttgcaaatgattcaagacaagactgagaattccactgcctgatttgcagaaagttgttgctgcctgaaaatgtgctgggcatgtcctgttgatagatagtacaaataaacagtgttaatacaatgggcaaacttcagagcatttccatagctcccgactattgaatgatatacaaaaatatatgacttggggacagctgaaattgtttccacactttgagctctgcttccattagactggttcacaatattagattgaatcccaaggtgctactgataatcatcagctgcttttcttgccaagaatctttgtttaaatgtattctttcattatccatgtgcttttgaaaaaaatgagggaaagaatgcttttaattgaataatctgtattctgtcaggtatttcttctccgtaggaaggtatctgaaaacttactttactttgctgtttttatttatcctgccagtgtagtatattgatgagagaactgaggtccaatagtgttaaaacaagacatgaaatattgattaattcttcttttaaattctctttttacccctgagtataacagatttcagaagctgctgccaataccatgctctccaataaacctccattattggaaggggggtcttgatacccttcaggctttgataaatgattattatgcttttgaaatgttagctttgagtgcctgaggcttgactttcatcagttcaagaaagaaacagtagaactgaagctgcaaagtttgagccaaaggcccccaaaggaaccatttcatgaaaggagttaaccatagatactgtggcttctgaactcgttgtccttgtcccacctgatactttttctgcattcctaattgtacattcccccattgcaggctaagacttgccctttgggtctaggcctactgagtttgctgatttctaaggttaaaaagtaagataatgggtttagatggacttgtaaagaagggagaaggaagtacgatgcttggttggatgaagaaaatcaggggactgtgaatgagcagagtaggaactggagattataggaatctggctgtttagggtcaaggacgccctcagagcaatcaccctaaggcaagaataggccctggggagtcaagaaatccactgccctcttaggacccagatgagcttggaacagaggggaatctgataaaatgtataagagaactgcacaggacagccactgcacaacaaagagttatcctgtccaaaatgttaatagtgctgagattgataaactctaatctagagaaagtgctacaattttttgccatcaaagtatgaatttcttgagttcagaacccaactcattgagctattggtattcaataattagcagagcatcctgtgaatagataataaatccaacataatccagttctcttttgaaaagtagccatttccatttcctcagttcctcccctgaaattatctgaaagggaaatgtcactcagttagaaggctccagcttgccagataatgggaggaaagtgcttcacgatatctttccagaaatgagaagaggacagagtgtgctcagaaacagaggtacaggcaaatgaaggttgctgacagccaaaaacactgagactggtaaacatcatgatagctgaacagacgaggaatccctgtatccatgtgatggcctttcgacatgaaggaataggggtaaacatcaagggtaaagtagcttatattttattgaaataaactagatgaaaggtcgtatcttaaatgatatgtcttcaagcatgtgctacatcaaggtcttgacggcatcattttcccaagagatatgccagtaaatttaagtagtttccaagttgtaagtatcttgattaccaaggagcagcagggtgcagagcctgaccggtaaaatcaaaggattgatggcttcctcttcacacgcctgcctttattttcccctgcatggcccattattctgctgcattaatttaagctttcctattgcacagaattaggggcttaaattctcttatcatccctgtgggaatcttgattgtttatttgtggatgagaataattgtttttattgatccccaaatgtggaaggtaaaaaaaaatgctatggttgatggccagctgatacatagttagtgctgcgtgcatgagtgacaaattatgagacagtatttggccccagaggatatcctttaagaatttttaaggcatttgatagttatcactttaaggcatttgatagttatcactaagtctttccaagctggaaatcataaacaatttcacatacatcaggtaaagtctttttgttgtagttttcattgaaacttaaaggtctagttgtgtgtaatttataatttctcatttccagtatgctcacacagcaactcggtagagtttggaaatggtacggctacaagacattctggagccagtgctatcaggccagtgagttcctctagggacccagattactaggcatttatttggaagaattcctggattcatccagaagttgtcattattccactgcaagcatcattgtatggacattagctccaaatagttagagaaaagaactactttgctagccctagcttgtactgtgggtaggaaaccccctgccatttaacatcccaaatatatcagaggcatcagggaaaggaactgcaactgtcaattaagtgctgtttgtaggacagggcacttgggcagtatgagcctcccccatctgaatcaaatgcaacacatcttgtttaaagagctattgagctaattagcatggcatgtctacacagaaataaaacaaatcaggttaggtcctaaaggaatcaagtatcagaaatgtggtaaagtttccttattaggtggtaagatggcaagatccttgaccagatgccaaaccctgaaattcttgatcttcttttcctgtgctaaagagaacatagatatatagagaagccactaatgaccattgtatcttctttattctttgagggctgtgttctggaagcttactgttgaaccttcagaaacgactgtgtgggctagaccagaatgagtcaggagagcttgcttgtttcacagaataagtgtccatatgtcacaaagaggatcttcctctttttcctggggatatcatattatctttgtctttgataattagcacctctgtgaagggaccacatcaaagggaggatgatttttcctaattatgatttttttttctcactcaaattcacctttacccttagcactatggttcagttatggccttggccttcgtcagccattgcaacaccttccatgagtggcagtgtaaaggagggaatcatggagttctccccacaaaagttttgtgactattgtcactaccattgcaaggtaaaaactttatacccagcttatatttttatatataccccatacatttagtgtcatgcccatcacacaagggagcatgaaatgtgatctgacgtattcacatgtttgctcattacaacatccaatatgcatagagcatggtaccgcacagtggttaaaacttaattacagactgttgagggtgatgatcacagaatcatagttcaaccatctcattttagacacaaggaaaataagacccagagaggctaaataagtggccaaagcctcatgttcgagtagcagcagagctgcaatatgaaaccagatatcctcactccaattctaactgcactctgtgttgactctgaaacacatggctgtgctttgttgcactgtattgtgatcaattgttttaacatgtgtgcctccctcactagaccatgtactcttaagaaaatattcatcaccagcttcctagcacagtcagtggcacataataggatcccaataaatgttggttgaaaaagtgaataaatgagtaaatacatgagacctgattttttcctcatcatatagaaacaaacaaatgccgtaacttttagtgatctctatgagtgcttggtcagcctgataatgaagaatagacaagatagggagtgaaaggtagaaaaaaatagtatgagaaagaagagaaaaaaaaagaatatacaattccataggaataataaccagacaaattcagtacatagacaaaatatttagattcaatttgggagcattttgtcaagactcttgcctcttctgatctcttctcattttcaaataagggctttttaagcagatggtgctttaagcaattcccatcattgctgctcctcctcaaaccccagaatgcaggattgactgcaggttaagttgtctaaaaggcaaagttgttcgttactgtagctcacttccctgagatacgtcttcccattcattttgcatctattgctgccccatgttgctgctactgtcacagaggaaagtgcatgtaactcactgtgatctagtttctgggatattttccatacaccagaagatgcgaaggaatggctacttaggtagtaacatttcagactcagtgacaagtatgcagagaggatgtatatgggctgagtctgtgtatccttgtaaatcacccaaagtcaatgcaagtaaaggctaaaaaatccaattatcaacccccactgtgagtttgtgtttttcctgaaatgctggcacattgtaagtaatttgacactaagtagtgcctgttaaaaagaagcagcagcagcagcagcaaaggattcaaggctcctaattatagcacactgatggcttggtactgggatgtgcatcaacaatattgagcatcagtagggagcaagtactggctggagggctgtatccagagagcggttatcagtatctaagtgtcagtttgaactggctgtgctcctgtaggccaagaagtctatatggaagatagaccatttaatctttttcagaggtgttgctacacagctatcaaacaaattggggtgctccaaatgcccccgtggagagttttaaggagatggacagtcatctcttttgaatggattgagtcacactggctaaagacaaatatggagatccagcttttcatttaacattcctttgaaccatttggaacttggcagatgcccaatcagcacttcatccaagtacatcaccaccttccccttcagttcctgcatttcccagctcttctttgaacataccaaccatacttccatatttgtgattttgtccttgcccttccctcttcctgaaataccttttcctcatgtggtccaagtggcttcttcctccttgaccctcccctctgtctttttcagatctttgttcccatgatcaaagaaggctttcctagccaaactttataatatagctacctccaaatccaacccactggccttcacaaagacagaaggtttggttgttttgatcgttgttgtatccccagcctccataacagtgattaccatgtagcttgttcaatggaaatacaatgaagaagttggtaacataggtcttaaaaaggaaaagtcttgtcttataatgcctggaaagcagttaagaaatcttttcagatgctttcatttcaagttattcacatacactgcatgtaagttacacttagaaacccaagcagccttcaagaaagtagtaatatgtccagttaagcaagatagcactattatcattcagttcccatctgggctccaagcaactttaagagaatctttcctctgatagacaggactaatttgtgtcttatggaaaattaaataaattatttttcacctgaagggataagattatttgacttcagatatttgctatatggcttctcttccacacaacatagctttgaggcttaaggtagtaagagcaagagcattcctataaattattcagagataattcaaaacaagtgtgcatctttgacatattgtcaagtttctcaactctttttcctgataacaagtgctatgtttttgatgaaatgttgctcgtttctcacacaccttattgttctgtgtgtgtgttctgtgttttgttctgtttgttattgtttgttttcatttccctcagagtccagtctggctcatatctcagcacagggtggtttaccttccttctggccatggacgcctgttatggcattcacgtctacgggatgataaatgacacctactgcaagtaagatcacaagaaattatttttatgcagctccaattcggagatcttgtcaaaatatcacaattcattttaataccataaatctgagaaacagataaagcaacaattatttcccagtgttctttgctgacatgacattttattgtcagtgcgtcaagttgtgacttctaggggtgagaaaaagaaaaatatttaccagtctaatgtcaaatgtcaggaggaacacttttcccttaatcagtggcatagcagggacttttggcttgaaaatacagaagaagtttagtggttgtgtaatttgcaaaagcaagtttgtcatttctgctgctctgatggcttgatggatagctatctactcaatggttagttagatttgatcatgaaggacaaaatgtcctgcagcctcagagaaactgacagcttaacaagaattcctggaaattatacttcactagtaagtgagtaatctgccagatccttatttaaaatgagtgtgtttacccacagtatatccttgctggtgggatagtttctaattagataatgaaacaaaccctccatgcttcatcaggataatggaatctatttccctaccaacaattggcacaatataattcacagactgttttaatcataatgtcaaaatggtaactctcagccacagtcttcatgaacaaatatttcttccctaactataagcataatggagctcagatgagccaatatcttactgtgaaaaatcacagtttcttcaagttctgcaagaggctatctaaagtttcttcaattatacaccatttccttttcaaaagatagccatatgtttgaatgtaattggcatgatatataaattttatttgatctattaaaccactaaaaacttggtacatcttcctaaaagctttcatacatataatagcttttaactgagttcatggacaagaatcatgtatgggtttgtgagtaaatgcatttactgggcacataatggattcttgtaaatgagtgcttcattcttcatctcaatctttctctccttttctttttttttcttttctaggacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatc

SEQ ID NO: 6 - DNA, 16102 bp, Homo sapiens
  misc_feature (1)..(16102): DNA nucleotide sequence of the entire ZNF660 genomic locus including 5000-bp upstream sequence.
ggagaggagcttgggggggggcttcattggtgaagtcctgcttgctagggaacgcccttttctcgctgcggccctggcgtgtgtcactggatggcgagggccccactgcattggtctccatgtgctctgccttctcaatgtccaaggcctcaaacttttcaatcacctgggacctcctgtggttgggggtgctggggctgggaggggagagcggcgggggcagctgctgttcttcggccttcaagtcgtgtttggtcttctccagagagaagtagctgctctccccccggactttgcggccacagtccatgcggtcgctactcatggcgctctcctcttctttgctctccagcccaggttcccgcagggagctggcagcaggaggctggctctggctgggactctgagctggactcagactgctgccatctggctggtccttggtcctcatttcttcctgccagagtgtggacttggtggtggggactttctcagcactggggatgctgctgctgctgctgctgctggtggtaacagccaccttggcaggcccaggctcctgcggtgtggggggctccactttccatttcttcttctgattctgcttgttggtccggggatagaccatgagcatctccagccacccactgacgatctccttggtctccgcccggatgaaatgctccttctcaggcgtcagaatacacagggagaacctctggcccgtgcggccctccccatccaccacatctgtgcactggttcatgttgatggtgccctgaggaagggtcgtgggcatctcatccagggcgtagcgcaagaggccatgctcgtaaaggatgaagaactgtcgctgccatttcggagaccggtgcactgagttgtcaaagtcggtcccatctggagccaggaggagccaaccgccataaatgggttttgcctgcgtcaggtcctcgtcgttgaggagatgcgactcgcggggctggaagcagttctgacacttgctcttgttgaagatgttggcctggaatttcctgcacgggttctccttggctgccgacatggtcggcgcggcggcggcggcggcgcaggcccggccggcctggcgctcccggcgggctaggggctcagcgcggccgccgccgcatccctcgccggccctgccacaggccctgaccggcctccttccctgcgggcggctcgctgcacgcgccgaggctcctgagccgcccgggcctcacagcgcgcgcgacgcccagctcccgcccgcaccgccgccgcccagccgccgtgggcccaaggacgcggcctcgggcccgctgcttcccgctgcggcccgcctctcaagctccggtcgccgccgtcccggctcgtccgcgccgccacagctgccctcagcgccccgcggccgctgcaaatgaccaattcttaagatatgtgaaaaaccattcagttgtagcaaacatcatacaccagagactttgtttgacatcagataaatcacacgggttagagaactttttggtttttagaggtcaaggaatcattcatcatgagcttccatattttgcacatatttctgaaaaatattcctgaagtggaaaagttttgttatacaacacatagttcctggtacatgagggaacccacgaaaaaaggtatcagtaaacagtgttacagaacttccaatttaatatatatatgttttagtcaaacagaattcaaacccaaggacagtttaggtggtggtcagacccagtgaaggtgctgggagtggtatacttactcacttacctcttaaacatgcaatgaaaatattctacagccaaacccttatcataaactccagccctggtcattcagcttctaaatgcagtaggaaatgtcaagagatggtggatgttaacaagttattgagtactgtcccatgttgggagacagttctgtcaagatgttgacctttttctggagtactacagagcgtgcattcctgaaaacctctaggggttagggacaggttgtgaatttgtcaattgtgaatacgcacatggtggcactataaaaagaattgaaagtaaatcccctatccctaacatcaggtcatgctctgccctgatggggaccagtagaatttgccacagctggatacagggaaggtgttaacgattacagctggctccacaagcacctagtggtgctagtacttgatccaggataggacattttagatttattattcaccaaatcataacagtcctccactaatatatgcacagggtcactttacccaggtggatgccaagtagggtgagatgcagactcccttttaaggcatgtgagtgctttacatgaaaacacaataggagagcaatgtatgacggcccacctttctggcctgtgggtattcctgaaatgatgcctggttaagacttgtcaactgactaaaattacaatgttttttccccttagatggcctagtccacaaacttaaaaagacctgaccaactagacgttgatttcatttacccaaatgagttagaatttctttggcagatagatgtcataataaagattgaaattgctgagtatttaggcaattatgacacacaaaaaaacaccctgatttctgagcagtgacattatacttgactgaatgaatagatttttgtaggaaaaagtatgcttgtggataagggcaatagaagctggatacaggcaggctggaatctatttttaacatatattctagtgacccttacgttctctaaaatttgagaattactggactagaatattaaggagtaatcattcctccctgggaccagatgtagggttagcagcttgaatcagaatgaatggccccacccacccaaatgaaagagtaggtgaaagggaagactaagtaagttaaagatcacagctcccttaatgtacatgaatattcgtgtgtgtgtgtgtgtgtgtgtgtgtgtgtgtgtgtgtgactgagtttcactcttgtcttccaggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatattaaatactgaatatttgtcaattgacgaagtacttcaaaagcttgattctcagactccttcttagataaatcattccctagattgtctcatcctgtcctgacaacttccaaatttatgtctttagctgtgatctcttcacggaagtccagactcctattccaactgcctgtttggcatttcatcttggatgtttaattggcatctttaacacatccaaaacaaaactattaatccctctccctaaacctgttcctttcaagctactcgatttctaaaagaccatcccatgctagttgctcagatcaataaccatggagtcatcagtaaccaacattcaattcattagcaaatcatgcaggccatgccttcaaaatatatgcagaaccatttctcactacctgcatcacttctaagcctgtccaagccactatcagtcctcatctggaatattgtaatggcctcttaatctccctgattctactcttacccaccttcagaccgttctcaacaagacagccaaagcaaactaaaaatataagtcaaagagcaaaattcatgcaaggtttatgttagaatggctaaggacagacagcaaagaattcacagaatttatagtaacaggcttcttggcttctttcatgtctcatagctaacaagtctttgaatatgtggtaagggaaaaaaagttagatcatgtcgttcctctgtccccaagccctccagctgttatgcagagcaaatccaaagcccttatcatagtctacaagatcctaaatgtgcacctctccaccccactcctgattaaagaattttgctcctaatggcccactatgggaatactctttccccagatagccacatgcttcaattgcccacttcctgtctctgccctccctgtcatctgtaaaatagtcccaccactatctccctctctccccttactccctctctccccttactgctacgttctacatatttatttatcattgtctccttgacttgaatgtaaactcaatggggcagagagttcattttcttcactactgtatccgcagcgcctggaacagtgagtgacatagtaggcacccaaaacgtcttttcatatgctgccaataaaccatagctgatcctggctttgaggctgaatgacccagatctgtggaaggaaagatgacctctctgctcagcaaccggagctgggggtgtaactttagggagtctcagcctgaggctggcagcctggccacccagatgctcggtctctttccgccctaaccaagccccctgcccagcttccaccacttccagggccctcctcacattggctgaagtcgccaagcccttccatccaatgatagggcaaagcccggaagggaggcagggccagagcgtcggccgaccgcgcggggcttctgaggggcggggggactccagcccgcgggcacagagatgtggaaacctcacgaagcctagaagggccggagggacaggctgggagttagctgggagttgctgacgcagttccttctgcgctttgttcaagatgtgggtctggcgctttcggtgaggggtgctctacagtctggcgtggggggtcgggccgggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggctggccgtggtgacagcactgtgtcgtccccgctcctaggcagtgggccttccgggtagtagcggtcgagtcccgcctaggctctcaggactccacagcccctgagtatttgactcaaatcaccagtccaatatccctcccgttaccagtgaggaacctggggcccagagaagaggacggagtcttgcccaaggttactcattcattcattgattcattcaacaaatatttattgagcactaacccagtagtgtgctaggtcctggggttatggttgtgtacaggacagaactaaattctagtaggggagaaatgaaacaaacttcaagggttagaagcagagcctggggatctggagggggaaacacaaaacatatttgaggcttagtaatcctaagaaatgggtaaacagaaaaaaggaacattctttttctagtgctcttttaaagacttgtttctttctgtcttcctaaagacacttgactcagcaaagttctccctctcatcccccttgtgcagactttctgtggaaagctggattgcaaggaagttctccactgcattgtattttgcagttagatgagaatatggaagcttttagatatcaatggagcaggtgaaaaggggaggctgtggtgtgatggaattaggatttcctgaagacacagaaggctttttaatcactcactagctataggaccttgggcaagtcgttcaatccctgggagcttcattccctcatctttacactggaaatgatccttcttactgcccacagttctataggaagggaagttacccaaagatgggacactgccctgagtgtccacttggaattcagggctcagagaactcagtcatttatatctgtttacagtgactcaagaccctcttaggaacttcttcactgaactcaaggaggagatcaggcaagatctgtgctgtgcagatcctttggattgaggctgctgtgcacaggaatatgggtgagtcattccattctctcctgggcaggtgaggcctagattgtgaagttagtctgggcacaggaatcctgcttgtgggcaccagggttgaaagggagcttctctcagtggtatttatcaaacaggagaaaagcactgaagtgggcagggggcctctggaccttgaggagtagagttttgtttcagatgggaataagggtgatgtagtagaactcaaaattgggtgtcatgggacttggatttgagtcccagctttcctctaagttccaagttttccttctgtacatttggatataagactggatagactgggaggttccttccagctctgacatactgagagtctctgaatagtgggaccaggtcaatctcttagggaatttagtccctgggatgactctgttgagacagaattgccaagaatgcaaatacaccattatggtgtttcccagataatatgaagcacaaaaaggacaaacatgtagaggagggatggtagtagtgatgtgtggatttggctctcagcatccctatgtgcactccaggtgttagaatcttaaacttgtttaatttaccatttcaaatcaaacaatgctgactgagccctctctgtgtcagacaccatgtggtatctacaggcaaatctcatgggaactgctctctgagggcatagagcttaatgtatatatttgaggatggacacagacatacacacaagcaattccagtataaggcaaactctattttatagatttgttatggcattttttggaatacagaaatttttatgtgtcagatatatcagctttttcacatggtgttagcctttcccttgaggcttaggcctttcttctaattctttttttttcttgcaatgtttacatttcacttatccatcccttgaatttattttcaggtatttcctcttattccttactccactgcacctaatcaataaccaagaaccatgtaaccattgcttagagggacttgaacaggcagatgatgctggtgaattaaaggaagacagcctccaagtaaagcctctctctctctctctcaataggattctaccctttatgtatttttcacagcctgaaatggatggtggtcctaggattagaacacttacctaccagtctcagagatttgtgggttagagatctgcagggccttatcagtcctcatacattcactggctgtctgagattttgcttttctgtacagttgcctagatacccctagtgtcctactggcctgtggcctcatgtttccctccaaacttctccagccaagaccctacttccttagtacctaggaattcttccaggatttctgagggcatttcctatccaatcagacagaagggagcaaataggtttctttttgatcaaactctcctcatttggccctctttgatctcctgtctggtcctgcttcctcctcagctcctccatcaccaccctgggctttcttacagtgcatcgctgtgcatttctctttctccctacctgcccctttgtgttaggctattcttgtgttgctgtaaagaaataccagccgggcgcggtggcttacgcctgcaatcccagcactttgggaggctgaggtgggcggatcacctgaggttgggagtttgagaccagcctgaccaacatggagaaaccccatctctactaaaaatacaaaaaattagctgggcgtggtggcacatgcctgtaatcccagctactcgggaggctgaggcagaggaatcacttgaacctgggaggcagaggttgtagtgagctgagatcacgccattgcactctagcctaggcaacaagagcgaaacttcgtctcagaaaaaaagaaagaaagaaagaaagaaatacctgtgactgggttaattgtaaagaaaagagtttaaattgactcactgttctgcaggctgtacaggaagcacggtgccagcatctgttcagtttctggggaggcctcaggaagcttttactcatggtggaaagtgaagtaggaggaggcagagcatggtgagagtaggagcaagagcaaggcagagggataccacacacttttaaacaacatgatctcacgagaactcactatcacaaggacagaaccaagaggatgacgataagccattcatgagaaatctacccccacgatccagtcacctcccaacaggcccacctccaacatagaagattacatttcaatgtgagatttggaaggaacatctaaatgatatcacttttctaacccaaatccctttctcagtaagcttatctgtttttttatttttttaatgtatttatttattttgagacaagttctcactgtctcccaggctggagtgtggcggcatgatcatagctcactgcagcctcgacctccctcagcctcccaagtagctgggaccacaggcatatgccaccacacctggctcactttttaaaatatttttacccaggctgatcaaacacctgggctcaggcagtcctcccacctcaccctaccaaagtgctgggattataggagtgagccaccgtgcccgaccctcagtaagtttatacattttcatgactccctctgtcctctctgtcttatcattctcaaatttgccttcgtgatatattcctcttcaccttgtctaaaatgtttctgtgtgtccccatcttgcttagtgacactaccattcttggtattcagacatggatctgatgaccttggattgtttccttcagtccatcctctgtattcaaaggaatatggatgtgtgcgttatacatctggatgcgttcctgaaaatagctagacttcattgttctctgttctctcatcttggattagggtcttgctatcttattcatttgttcattcattcaacaaacgtttattgggtacctacaacgtgccagaccctccagtgttcacctgtaccgcatgactagtgttgtctcctaattcatttcccttcctcttttctttttaaccccctctaatccatctgggctaatcttcctaaagagttcttatcctaatttcacttttgggtaggataatgcaaaatttattgtccaaacggggatactgttgtgagttaagggagccattattaaatatgatgctgggatagtaggcttaaactagcactattctgggaaaaccaggatatatgattgccctacttgacatctcttggattctttactttctgtttccctcaatttactccccatgtgttatcccagctgcctctctcctctgttttccatttcattaagctgagagaaacgtgaatgttctgggaggtggtagtggaggaactatgggaactaggggaagtgcatggtaatgcttgaaaaactgtattgttaagtgagaaaaagaaggaaaataacaagagtggagaatagcaaggtacaaaaaagaatatagaatggagaaagaaaattaaggatagatttcactcttctgtttagaactggtttccctttgaccatcagtttatatccatatttttcatcttgtaatttcagtattctggttggaatcacttcaggcagcttgattctttcttcatttgttaattccaacaacaaaaaatgttgagcgcttaccatgtgcctgggactgtggtagtgctaggaatacagggtaagcaggacggacaaaatccctgcctacatgaagtttatataatattatgatctcccatttattttcatgtataccaaccctgtgcctttttttttttttttttttttttgagaaaacactgcttattctccagggctcagcctaaattctgcctttttaaaatgcttttctccatcattccatgccttagtaattgctccctccctcccctagtcctcttcatctcctgcttgcatacattgtaaatttgaatttgctctcttattgtttttccatactactccattgtaagctctttaagggaagtatgatatttcatgcttgtattagtgtgcttgggttaccataacaaaatgccataaactgagtggcttaaacaacagaaacttattttctcacagttctgcagcctagaagtgtgagatccatgtgcctcgccattttggtttctggtagggggctctcatcctgtcttgtagctggccatcttcttactatgtattctcatagcctttatgtgtatgtgtgtggagagagggagagcatgtaagagaactttcttgtgtttctttttataaggacatgaattctgttggatcagggcccacccttatgacctcatttaaccttaattatctccttagaggccccatctccaaatacagtcacattgggggttagagctttaacatacaaatgttagggggacacaaacattcagtccatgacaatgcttctttaaattttccctgtgttagacccagaacagggatatatacagagtagggtgctcattagttatgagtttaagaaatgtatgaagaaaagagaagttccagagaagatgagaaattgaaaagaaattcagaaaaaactatcaactttctcacagaactttgaaggtgagttcacttgctctactgctctgcattgcagtcccctggctttgcactgttttctccacctgcttcatccttaatgattaggagaggtagcagcagctggatgtgagtgagcccaggaccctggcaagaatccaccctccctcaccattctctcttcctacccttcttatcttgggcatgagtttgtgtgtatgtgcctgtgtatggaatcagtggccacccgcatttctgagatgtgaactcgaatatgtgcagttatctttttgccagtctcgagtgccaccatttgctatcttccttctccagaaagtgtggctccatttatcagaaagctgtgggacatggaaattggtcaaacttttttttttgagacaaagtcttgctctgttgcccaggctgaagtgcagtggcataatcagggctcactgcagcctggacctcctgggctcaagcaatcctctcacctcagcctcctgagtaattgggactacaggtgcacaccaccatgcctagctaatttttaaattctttgtagagatgtagtctccctgtcttaccctggctggtctcaaacttttgggcccaagtgatcctcccgcctcagccttgcaaagtgctgagattatagacatgtgccaccatgctcagcccatcaaacttttttgaatagcaacaagcaatactgcacaacagttgcactccttctgacccaattaactcatttgtggaacttttgtcctaggaatatattttaataggaagaaaattttgtgtgtataaagagattatgatagcattattgatagtagttaacttcaaggaacaacagaaatgtccaacactagcaaaatggtaggtaaattagaaggaattcaatgatcatatgaagattaaatagcaatgtggaaaaatgtgcattaaaaaattaagtggaggctgggcgcagtggttcacgcctgtaatcccagcactttgggaggccgaggcaggtggatcacctgaggtcaggagttcaaggccagcctggccaacatggcgaaataccatttctacttaaaaaatacaaaaactagccaggcgtggtggcagacgcctgtaatcccagctactcaggagggtgaggcagggagaattgcttgaatccaggaggcggaggttgtagtgagtggagattgaaccactgcactctagcctgggcaacagagcgagcctccgtctcaaaaaacaaaaaaaaatttgtgaggcagggattagggagatgttggtcaaaggatacaaaaattctgttaggaggaataatttcaggaaatctattgtattacatggtaattatagttaatatcaacatatttagacttgaaaagtgctaagagagattttaaatgttcttaccatgaaaaaataataagtatgtgaagtaatggatatgttaattagcttgatttacctgttccatgtgtaaacatttataaaaacatgttgtatgccataaatatatatacttttttatcaactaaaaaataaatgaaatgaactgcaagaagtaggatgcaaaataatatctaccatatttaattgtctaacaaaatacatatgggcaagtctataaaggagcatagtcatgtgttagtatcatgtagttatctttttgctttcttttacatcccaactccctctaaggtctgccatggttacctgtatgtccagagtttcacgtcaaaccagttgggaaattcctccttattctgatgtttggtttcatgtattggcacctcttggttatgctgcccctactctgacgcttttgccatccttagatactttactattatgccatgcaagatcctatcagagtttcatctgccatgctttaactaaccttctttcccaatttagcctctcagactcaccccttaagtagtctcagtctgtcagagtgacagcatggtgaaaagcagacagactacacttgcatataaaactggatccaactggctgggcgcggtggctaacgcctgtaatcctagcactttgggaggccgaggcaggtggatcacgaggtcaggagatcgagaccatcctggctaacacagtgaaacctcgtctctactaaaaatacaaaaaattagccaggcgtggtggcgggcgcctgtagccccagccactcgggaggctgaagcaggagaacggcgtgaacctgggaggcggagcttgcagtgagccgagatcgtgccactgcactccagcctgggcgacagagtgagactccgtctcagaaaaaaaaaaaaaactgggtccaactataggccagcccctatgaagtaggctatgatgtgactaggctcaatattgaaagaactgtgtcaccacttaacaagatagggtttacctgcaaggatgtagactggggtctagtacctggaccttgagcaaaagatgaaatcctactcacaacctaagacagaatcctagttgctattctataataccattttgagcaccttttacatactggccacagtatcactagtactaggggaataggttagcaagaactaaaagccaaactgaactaaagtttagtcatctttcagttcactttttctaggaccagattatagttgagcctgccattaggagttagatggctctgagctgggtgcggtggctcatgcctataatcccagcactttgggaggctgaggcaggtggatcacctgaggtcaggagttcaagaccagcctggccaacatagtgaaaccccatctctgctaaaaatacaaaaaattagctgggcgtggtggcaggcgcctgtaatcccagttactagggaggctgaggcaggagaatcgcttgaacctgggaagcggaggttgcagtgagtcaagatcgtgccattgcactccatctcaaaaaaaaaaaaaaaaaaagcaacgagttagatggctccaattcagggagtagaggatgaggcaggaaggaactagggtagattttatacgattcattgcttattctgatgctggacctgctgggctccccttagcccctggctttccataagcctttacattggcctctatgtttaacttcatttttgtcatctttttgatctgttcccctgcccttgaacacttaacccttccatatggctaccacatcttgtccgtggatagatctccttcctctggtacagagaataggtgacatgtgcaatttctgtttctcctgtcagatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaaatgagagagttcaggctgaaaagagacagtatgtatgtactgagtgtgggaaagcctttagtcagagtgcaaacctcacagtacatgagcgaatccacacgggagagaaaccctataagtgtaaggagtgtggaaaagctttcagtcatagctctaaccttgttgttcatcggagaatccacactggactgaagccctatacatgcagtgaatgtgggaaatctttcagtggaaagtcacatcttattcggcaccagggaatccacagtggggagaaaacttatgaatgtaaagagtgtgggaaagcctttagtcggagttcgggccttatatcacatcacagagttcacaccggagagaagccctattcttgtattgagtgtgggaaagcctttagccgtagttcaaaccttactcaacatcagcgaatgcacagaggaaaaaaagtttacaaatgtaaggagtgtgggaaaacatgtggttctaatacaaagattatggaccatcagagaattcacactggagagaagccttatgaatgtgatgagtgtggaaaaactttcatcttaaggaaaactcttaatgaacaccagagacttcatcgtagagagaaaccttacaaatgtaatgagtgtgggaaggcttttacttctaatcgaaaccttgttgatcatcagagagttcacactggagagaaaccctataaatgtaatgaatgtgggaaaaccttcaggcagacttctcaagttattctacacttgagaacccacactaaggagaaaccctataaatgtagtgagtgtgggaaagcctatcggtatagttcacagcttattcaacaccagaggaaacataatgaggagaaagaaacctcataaataacaaatattgtgggtagtagggctgactgctgcttttctaaaaagtagttctttagtatcaactttaattctacttctaagaatcatactctacttctaagaaaataattagaagtagacaaagattaatgaaagggatgttcatgacagcatcatatacgactgaaagaagaaaactagattttcaacattacagggttgaaatgaatgatgagctatccatatgatggttctgcagccattgcaaacatttttaaagacaatttaatgccatggggaaatgattggataagacggaagataatgacatacaatccaaaatttaaaaaaatatttttgcataggaaaaattgagaaggaagtaaaccaaaatgttaacagtgatcatctctgggcgataggattataggtgatttctattttcttctgtatacttttctatgctttctagattatctacatgagaatatactaattttatatgcaagaaaaaaagcacagtattttttaaatgcaatgaagacgtgcttattttcactcagcagtgttatgaaaggcacgtagtatatagagcccaaagccctgggattgcaccctgacactggcatttagcagcagtggaaccgcgagcaagtcccttccttttagagcgtgtttcctgttaagtaaaatcataaacaccgatcctttgtcctttttagttttaagacaagctgactttagagttgtcaacaaaatatataataacactgttaggttaaaagaacacagcaaaaattcactgaaccctcctttcccacagttctggaaggatctgcagatgatggagaactacctaggcttcatcttttcaacatatgtctacacaaccag

SEQ ID NO: 7 - DNA, 4949 bp, Homo sapiens
  misc_feature (1)..(4949): AOX1 transcript nucleotide sequence
cgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgatagaaaaaaatgtcgatcctgaaacaatgctgttgccttatttgaggaagaagcttcgactcacaggaactaagtatggctgtggaggaggaggctgtggtgcttgtacagtgatgatatcacgatacaaccccatcaccaagaggataaggcatcacccagccaatgcctgtctgattcccatctgttctctgtatggtgctgccgtcaccacagtagaaggcataggaagcacccacaccagaattcatcctgttcaggagaggattgccaagtgtcatggcacccagtgtggcttctgcacacctgggatggtgatgtccatctacacgctgctcaggaaccacccagagcccactctggatcagttaactgatgcccttggtggtaacctgtgccgttgcactggatacaggcccataattgatgcatgcaagactttctgtaaaacttcgggctgctgtcaaagtaaagaaaatggggtttgctgtttggatcaaggaatcaatggattgccagaatttgaggaaggaagtaagacaagtccaaaactcttcgcagaagaggagtttctgccattggatccaacccaggaactgatatttcctcctgagctaatgataatggctgagaaacagtcgcaaaggaccagggtgtttggcagtgagagaatgatgtggttttcccccgtgaccctgaaggaactgctggaatttaaattcaagtatccccaggctcctgttatcatgggaaacacctctgtggggcctgaagtgaaatttaaaggcgtctttcacccagttataatttctcctgatagaattgaagaactgagtgttgtaaaccatgcatataatggactcacccttggtgctggtctcagcctagcccaggtgaaggacattttggctgatgtagtccagaagcttccagaggagaagacacagatgtaccatgctctcctgaagcatttgggaactctggctgggtcccagatcaggaacatggcttctttagggggacacatcattagcaggcatccagattcagatctgaatcccatcctggctgtgggtaactgtaccctcaacttgctatcaaaagaaggaaaacgacagattcctttaaatgagcaattcctcagcaagtgccctaatgcagatcttaagcctcaagaaatcttggtctcagtgaacatcccctactcaaggaagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggatccagttcactatcctagccttgcagacaagtatgaaagtgctttagaagatcttcattccaaacatcactgcagtacattaaagtaccagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtctattgatctgtcagaagctctcagcatgcccggtgtggtggacatcatgacagcagaacatcttagtgacgtcaactccttctgcttttttactgaagctgagaaatttctggcgacagataaggtgttctgtgtgggtcagcttgtctgtgctgtgcttgccgattctgaggttcaggcaaagcgagctgctaagcgagtgaagattgtctatcaagacttggagccgctgatactaacaattgaggaaagtatacaacacaactcctccttcaagccagaaaggaaactggaatatggaaatgttgacgaagcatttaaagtggttgatcaaattcttgaaggtgaaatacatatgggaggtcaagaacatttttatatggaaacccaaagcatgcttgtcgttcccaagggagaggatcaagaaatggatgtctacgtgtccacacagtttcccaaatatatacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaaacatggccgtgcagttcgctgtgttctggaacgaggagaagacatgttaataactggaggccgccatccttaccttggaaagtacaaagctggattcatgaacgatggcagaatcttggccctggacatggagcattacagcaatgcaggcgcctccttggatgaatcattattcgtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggctgctgccttggttcacatttatcttgatggctctgtgctggtcactcacggtggaattgaaatggggcagggggtccacactaaaatgattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggatgcctgtcaaactcttctaaaacgcctcgaacccatcatcagcaagaatcctaaaggaacttggaaagactgggcacagactgcttttgatgaaagcattaacctttcagctgttggatacttcagaggttatgagtcagacatgaactgggagaaaggcgaaggccagcccttcgaatactttgtttatggagctgcctgttccgaggttgaaatagactgcctgacgggggatcataagaacatcagaacagacattgtcatggatgttggctgcagtataaatccagccattgacataggccagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatgattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatatttgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaaaaaaaaaaaaaaaa

SEQ ID NO: 8 - DNA, 1866 bp, Homo sapiens
  misc_feature (1)..(1866): C1orf114 transcript nucleotide sequence
cgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttttaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtg

SEQ ID NO: 9 - DNA, 2521 bp, Homo sapiens
  misc_feature (1)..(2521): GAS6 transcript nucleotide sequence
ccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaaaaaaaaaaaaaaaaaa

SEQ ID NO: 10 - DNA, 1893 bp, Homo sapiens
  misc_feature (1)..(1893): HAPLN3 transcript nucleotide sequence
cccgaaatcagactgctgccttggaccgggacagctcgcggcccccgagagctctagccgtcgaggagctgcctggggacgtttgccctggggccccagcctggcccgggtcaccctggcatgaggagatgggcctgttgctcctggtcccgttgctcctgctgcccggctcctacggactgcccttctacaacggcttctactactccaacagcgccaacgaccagaacctaggcaacggtcatggcaaagacctccttaatggagtgaagctggtggtggagacacccgaggagaccctgttcacctaccaaggggccagtgtgatcctgccctgccgctaccgctacgagccggccctggtctccccgcggcgtgtgcgtgtcaaatggtggaagctgtcggagaacggggccccagagaaggacgtgctggtggccatcgggctgaggcaccgctcctttggggactaccaaggccgcgtgcacctgcggcaggacaaagagcatgacgtctcgctggagatccaggatctgcggctggaggactatgggcgttaccgctgtgaggtcattgacgggctggaggatgaaagcggtctggtggagctggagctgcggggtgtggtctttccttaccagtcccccaacgggcgctaccagttcaacttccacgagggccagcaggtctgtgcagagcaggctgcggtggtggcctcctttgagcagctcttccgggcctgggaggagggcctggactggtgcaacgcgggctggctgcaggatgccacggtgcagtaccccatcatgttgccccggcagccctgcggtggcccgggcctggcacctggcgtgcgaagctacggcccccgccaccgccgcctgcaccgctatgatgtattctgcttcgctactgccctcaaggggcgggtgtactacctggagcaccctgagaagctgacgctgacagaggcaagggaggcctgccaggaagatgatgccacgatcgccaaggtgggacagctctttgccgcctggaagttccatggcctggaccgctgcgacgctggctggctggcagatggtagcgtccgctaccctgtggttcacccgcatcctaactgtgggcccccagagcctggggtccgaagctttggcttccccgacccgcagagccgcttgtacggtgtttactgctaccgccagcactaggacctggggccctcccctgccgcattccctcactggctgtgtatttattgagtggttcgttttcccttgtgggttggagccattttaactgtttttatacttctcaatttaaattttctttaaacatttttttactattttttgtaaagcaaacagaacccaatgcctccctttgctcctggatgccccactccaggaatcatgcttgctcccctgggccatttgcggttttgtgggcttctggagggttccccgccatccaggctggtctccctcccttaaggaggttggtgcccagagtgggcggtggcctgtctagaatgccgccgggagtccgggcatggtgggcacagttctccctgcccctcagcctgggggaagaagagggcctcgggggcctccggagctgggctttgggcctctcctgcccacctctacttctctgtgaagccgctgaccccagtctgcccactgaggggctagggctggaagccagttctaggcttccaggcgaaagctgagggaaggaagaaactcccctccccgttccccttcccctctcggttccaaagaatctgttttgttgtcatttgtttctcctgtttccctgtgtggggaggggccctcaggtgtgtgtactttggacaataaatggtgctatgactgccttccgccatcccca

SEQ ID NO: 11 - DNA, 3259 bp, Homo sapiens
  misc_feature (1)..(3259): ST6GALNAC3 transcript nucleotide sequence
ggggtctgtggcggcgcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagttt

SEQ ID NO: 12 - DNA, 2205 bp, Homo sapiens
  misc_feature (1)..(2205): ZNF660 transcript nucleotide sequence
agttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatggatggtgaaactgggactgaggaggagttaattccaaagcatcattcctgaaaaatcagaatcatacatactttcaagagaattccacagagacattgcccaggaagtcaaaatttagaaggctcctctgaagggaaagagaagactagagaggacactggtatgttccaagcaggagaaaatgaggagaaagacaagaaatttcaaacataagacagttaaagacaataaagtactcacagaagggagtgaccaagaatctgaaaaagacaatagtcagtgctgtgaccctgcaacaaatgagagagttcaggctgaaaagagacagtatgtatgtactgagtgtgggaaagcctttagtcagagtgcaaacctcacagtacatgagcgaatccacacgggagagaaaccctataagtgtaaggagtgtggaaaagctttcagtcatagctctaaccttgttgttcatcggagaatccacactggactgaagccctatacatgcagtgaatgtgggaaatctttcagtggaaagtcacatcttattcggcaccagggaatccacagtggggagaaaacttatgaatgtaaagagtgtgggaaagcctttagtcggagttcgggccttatatcacatcacagagttcacaccggagagaagccctattcttgtattgagtgtgggaaagcctttagccgtagttcaaaccttactcaacatcagcgaatgcacagaggaaaaaaagtttacaaatgtaaggagtgtgggaaaacatgtggttctaatacaaagattatggaccatcagagaattcacactggagagaagccttatgaatgtgatgagtgtggaaaaactttcatcttaaggaaaactcttaatgaacaccagagacttcatcgtagagagaaaccttacaaatgtaatgagtgtgggaaggcttttacttctaatcgaaaccttgttgatcatcagagagttcacactggagagaaaccctataaatgtaatgaatgtgggaaaaccttcaggcagacttctcaagttattctacacttgagaacccacactaaggagaaaccctataaatgtagtgagtgtgggaaagcctatcggtatagttcacagcttattcaacaccagaggaaacataatgaggagaaagaaacctcataaataacaaatattgtgggtagtagggctgactgctgcttttctaaaaagtagttctttagtatcaactttaattctacttctaagaatcatactctacttctaagaaaataattagaagtagacaaagattaatgaaagggatgttcatgacagcatcatatacgactgaaagaagaaaactagattttcaacattacagggttgaaatgaatgatgagctatccatatgatggttctgcagccattgcaaacatttttaaagacaatttaatgccatggggaaatgattggataagacggaagataatgacatacaatccaaaatttaaaaaaatatttttgcataggaaaaattgagaaggaagtaaaccaaaatgttaacagtgatcatctctgggcgataggattataggtgatttctattttcttctgtatacttttctatgctttctagattatctacatgagaatatactaattttatatgcaagaaaaaaagcacagtattttttaaatgcaatgaagacgtgcttattttcactcagcagtgttatgaaaggcacgtagtatatagagcccaaagccctgggattgcaccctgacactggcatttagcagcagtggaaccgcgagcaagtcccttccttttagagcgtgtttcctgttaagtaaaatcataaacaccgatcctttgtcctttttagttttaagacaagctgactttagagttgtcaacaaaatatataataacactgttaggttaaaagaacacagcaaaaattcactgaaccctcctttcccacagttctggaaggatctgcagatgatggagaactacctaggcttcatcttttcaacatatgtctacacaaccag

SEQ ID NO: 13 - protein, 1338 aa, Homo sapiens
  MISC_FEATURE (1)..(1338): AOX1 amino acid sequence of the AOX1 protein
MDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 14 - protein, 508 aa, Homo sapiens
  MISC_FEATURE (1)..(508): C1orf114 amino acid sequence of the C1orf114 protein
MNENKDTDSKKSEEYEDDFEKDLEWLINENEKSDASIIEMACEKEENINQDLKENETVMEHTKRHSDPDKSLQDEVSPRRNDIISVPGIQPLDPISDSDSENSFQESKLESQKDLEEEEDEEVRRYIMEKIVQANKLLQNQEPVNDKRERKLKFKDQLVDLEVPPLEDTTTFKNYFENERNMFGKLSQLCISNDFGQEDVLLSLTNGSCEENKDRTILVERDGKFELLNLQDIASQGFLPPINNANSTENDPQQLLPRSSNSSVSGTKKEDSTAKIHAVTHSSTGEPLAYIAQPPLNRKTCPSSAVNSDRSKGNGKSNHRTQSAHISPVTSTYCLSPRQKELQKQLEEKREKLKREEERRKIEEEKEKKRENDIVFKAWLQKKREQVLEMRRIQRAKEIEDMNSRENRDPQQAFRLWLKKKHEEQMKERQTEELRKQEECLFFLKGTEGRERAFKQWLRRKRMEKMAEQQAVRERTRQLRLEAKRSKQLQHHLYMSEAKPFRFTDHYN

SEQ ID NO: 15 - protein, 678 aa, Homo sapiens
  MISC_FEATURE (1)..(678): GAS6 amino acid sequence of the GAS6 protein
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 16 - protein, 360 aa, Homo sapiens
  MISC_FEATURE (1)..(360): HAPLN3 amino acid sequence of the HAPLN3 protein
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 17 - protein, 305 aa, Homo sapiens
  MISC_FEATURE (1)..(305): ST6GALNAC3 amino acid sequence of the ST6GALNAC3 protein
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 18 - protein, 331 aa, Homo sapiens
  MISC_FEATURE (1)..(331): ZNF660 amino acid sequence of the ZNF660 protein
MRRKTRNFKHKTVKDNKVLTEGSDQESEKDNSQCCDPATNERVQAEKRQYVCTECGKAFSQSANLTVHERIHTGEKPYKCKECGKAFSHSSNLVVHRRIHTGLKPYTCSECGKSFSGKSHLIRHQGIHSGEKTYECKECGKAFSRSSGLISHHRVHTGEKPYSCIECGKAFSRSSNLTQHQRMHRGKKVYKCKECGKTCGSNTKIMDHQRIHTGEKPYECDECGKTFILRKTLNEHQRLHRREKPYKCNECGKAFTSNRNLVDHQRVHTGEKPYKCNECGKTFRQTSQVILHLRTHTKEKPYKCSECGKAYRYSSQLIQHQRKHNEEKETS

SEQ ID NO: 19 - DNA, 501 bp, Homo sapiens
  misc_feature (1)..(501): Nucleotide 4796-5296 of SEQ ID NO.: 1. CpG island in AOX1 gene promoter
cgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggccggggcagagaggagcccctgccgttcgtcccatcctttcgtgcccgccgtttaaggcactcaggcacggactggctttctcccgtaacagcggctttgccttcg

SEQ ID NO: 20 - DNA, 248 bp, Homo sapiens
  misc_feature (1)..(248): Nucleotide 4801-5048 of SEQ ID NO.: 2 CpG island in C1orf114 gene promoter
cggcacttcgcgagtctctataacgttagtgatgcgtggattccttagtcgtccccttagaaacctcagcttcactggcccttcgcaagcaccgggatgggtgccgggaggggtcggtggtctgaggatattgcatgcgcctgcgcagatttttgtcgctctcgtagttagagaggcccggatggaggacgcagaggcacgctgttgccatggcagtgtggtcctggctgccgcggaggcaggtgccg

SEQ ID NO: 21 - DNA, 1399 bp, Homo sapiens
  misc_feature (1)..(1399): Nucleotide 4840-6238 of SEQ ID NO.: 3, CpG island in GAS6 gene promoter
cgcctggggagacgctccttttccgaaacactcgagtcccgccgcgtcccggacgctccgctttccccgcgcccggatcctcccgggaacccgcgccccgcccgcgcgctggtcccgcccccgccgcctccccgcgcgcagccgcccgaacacgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccg

SEQ ID NO: 22 - DNA, 674 bp, Homo sapiens
  misc_feature (1)..(674): Nucleotide 4920-5593 SEQ ID NO.: 4 HAPLN3 gene
cgcgtgttcctttaaggggctggtctggcgggagcgcgggggtttttctgctgccgcttcctttctgcccttttaatttccccgaaatcagactgctgccttggaccgggacagctcgcggcccccgagagctctagccgtcgaggagctgcctggggacggtacgtggcttaggggtcgctgggcttctggggctgtgtgcgggccgggttcctcccttaccgctttgggtgccctgcgggtccccacacctcccgggcagggtccggggaaggggcaggaggcgtgggccgggcactgcggaggcccgggctgagatgggctgtgatcgcgggcgaggggcgcccggggcacaagtggggagggagcggcgcggggatgcgggcgccggaccctcgtgcccaccgtgagggagcagagcccgagcggaccccgtggcctccgagaccaccgtccgcctccagcccccttcctgccagggtccgcttggctctctcccctgtcgtctgtccagggtcggctgcctccagtgccgtccgcggcgccccaggccctgcccctgggtatctgttggatgctccgggggccccgggagtcctgggaggggctgagggcaacctgcgaggcggctggcggacctgcgcctctggaccgcagctggccggctctgggcg

SEQ ID NO: 23 - DNA, 506 bp, Homo sapiens
  misc_feature (1)..(506): Nucleotide 4759-5264 of SEQ ID NO.: 5. ST6GALNAC3 gene
cggaaccgagaagaaaaggccgtactctgccccccgcgggacccaggtccccgcctgctgcagagcgcactctgcgcacgtcgagccgcgaaaggttcacagaagaaaacaagagaaagaagtagcaggcactgaggagccgccggcgccggcgcccaggacggcacgtgacccgggggcggggccgcgcgggccgcgggccagtggatggggacgggggcggggccgcggctcggggggcggggtctgtggcggcgcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaaggtaacgacttggatctgtggctcggacgcgtggttggccagccccttgctgctcagaggcacggagtcagccgcggtcccaccg

SEQ ID NO: 24 - DNA, 20 bp, Artificial Sequence
  PCR primer
ctaaaggctgcgttttcagg

SEQ ID NO: 25 - DNA, 20 bp, Artificial Sequence
  PCR primer
cttgtgagccttggaaggag

SEQ ID NO: 26 - DNA, 20 bp, Artificial Sequence
  PCR primer
gggagggagggtaggtagtg

SEQ ID NO: 27 - DNA, 20 bp, Artificial Sequence
  PCR primer
ttaccagacttccccaccag

SEQ ID NO: 28 - DNA, 20 bp, Artificial Sequence
  PCR primer
gctcttttccaccagctttg

SEQ ID NO: 29 - DNA, 20 bp, Artificial Sequence
  PCR primer
ctcgcgctctctctttccta

SEQ ID NO: 30 - DNA, 20 bp, Artificial Sequence
  PCR primer
ctctctcccatcccttctcc

SEQ ID NO: 31 - DNA, 20 bp, Artificial Sequence
  PCR primer
cctagtcccagggctttgat

SEQ ID NO: 32 - DNA, 20 bp, Artificial Sequence
  PCR primer
cagtgggattggatctgacc

SEQ ID NO: 33 - DNA, 20 bp, Artificial Sequence
  PCR primer
cccgaatctactgcatcctt

SEQ ID NO: 34 - DNA, 20 bp, Artificial Sequence
  PCR primer
atcagactgctgccttggac

SEQ ID NO: 35 - DNA, 20 bp, Artificial Sequence
  PCR primer
caaagcggtaagggaggaac

SEQ ID NO: 36 - DNA, 20 bp, Artificial Sequence
  PCR primer
tatctcctcgtgggttcctg

SEQ ID NO: 37 - DNA, 20 bp, Artificial Sequence
  PCR primer
tccacccatcctctgaactc

SEQ ID NO: 38 - DNA, 20 bp, Artificial Sequence
  PCR primer
cctgatcctgagggaggagt

SEQ ID NO: 39 - DNA, 20 bp, Artificial Sequence
  PCR primer
ttgttggccccaaagttaag

SEQ ID NO: 40 - DNA, 25 bp, Artificial Sequence
  synthetic construct
gggaagagtttttggtaaagagttt

SEQ ID NO: 41 - DNA, 25 bp, Artificial Sequence
  synthetic construct
ataaaaacccaaaaatccaaaacaa

SEQ ID NO: 42 - DNA, 20 bp, Artificial Sequence
  synthetic construct
tttcgtaatagcggttttgt

SEQ ID NO: 43 - DNA, 20 bp, Artificial Sequence
  synthetic construct
caaaacaatccctaaaaacg

SEQ ID NO: 44 - DNA, 25 bp, Artificial Sequence
  synthetic construct
tcgtatttttatttttgttttcggg

SEQ ID NO: 45 - DNA, 26 bp, Artificial Sequence
  synthetic construct
tttttatattgaggtaaaggagattt

SEQ ID NO: 46 - DNA, 24 bp, Artificial Sequence
  synthetic construct
aaaaaaatttcacaaccaacacaa

SEQ ID NO: 47 - DNA, 20 bp, Artificial Sequence
  synthetic construct
atttgcgtaggcgtatgtaa

SEQ ID NO: 48 - DNA, 21 bp, Artificial Sequence
  synthetic construct
cgtaaattccttaatcgtccc

SEQ ID NO: 49 - DNA, 21 bp, Artificial Sequence
  synthetic construct
tcggtgtttgcgaagggttag

SEQ ID NO: 50 - DNA, 26 bp, Artificial Sequence
  synthetic construct
ggtagtaggtttaaaaataagatttt

SEQ ID NO: 51 - DNA, 24 bp, Artificial Sequence
  synthetic construct
ctataaaatcaccctaacttcaaa

SEQ ID NO: 52 - DNA, 20 bp, Artificial Sequence
  synthetic construct
ggtttcgttttgttaggtgt

SEQ ID NO: 53 - DNA, 19 bp, Artificial Sequence
  synthetic construct
attcctaaccgaaataccg

SEQ ID NO: 54 - DNA, 21 bp, Artificial Sequence
  synthetic construct
gcgggtgtttttaggagttcg

SEQ ID NO: 55 - DNA, 20 bp, Artificial Sequence
  synthetic construct
gattttggtaggaagggggt

SEQ ID NO: 56 - DNA, 24 bp, Artificial Sequence
  synthetic construct
cccaacccttaaaaaaaaaaaata

SEQ ID NO: 57 - DNA, 22 bp, Artificial Sequence
  synthetic construct
cttttcgtagtgttcggtttac

SEQ ID NO: 58 - DNA, 18 bp, Artificial Sequence
  synthetic construct
gaattcctcccttaccgc

SEQ ID NO: 59 - DNA, 20 bp, Artificial Sequence
  synthetic construct
tcggattttgttcgggaggt

SEQ ID NO: 60 - DNA, 23 bp, Artificial Sequence
  synthetic construct
ccaactccaaatcccctctctat

SEQ ID NO: 61 - DNA, 26 bp, Artificial Sequence
  synthetic construct
tggtttttttagggagtaagtttgtt

SEQ ID NO: 62 - DNA, 36 bp, Artificial Sequence
  synthetic construct
tcccttcctattcctaaatccaacctaaatacctcc

SEQ ID NO: 63 - DNA, 26 bp, Artificial Sequence
  synthetic construct
gaaagaagtagtaggtattgaggagt

SEQ ID NO: 64 - DNA, 26 bp, Artificial Sequence
  synthetic construct
tttgtttttaggattgtttttgattt

SEQ ID NO: 65 - DNA, 24 bp, Artificial Sequence
  synthetic construct
ttaccttcaaaatacaaaccataa

SEQ ID NO: 66 - DNA, 26 bp, Artificial Sequence
  synthetic construct
catatttcaaaatctccctccatata

SEQ ID NO: 67 - DNA, 23 bp, Artificial Sequence
  synthetic construct
gggtatagagatgtggaaatttt

SEQ ID NO: 68 - DNA, 23 bp, Artificial Sequence
  synthetic construct
cccaaaacaaaaaaacaacacta

The invention claimed is:

1. A method of detecting a methylation level of C1orf114 in a patient with clinically localized prostate cancer comprising:
    (a) contacting a tumor sample from the patient comprising one or more nucleic acid molecules treated with an agent that modifies unmethylated cytosines with singe-stranded nucleic acid molecules, wherein at least one of the single-stranded nucleic acid molecules specifically hybridizes with nucleotides of two or more methylated CpG sites of C1orf114; and
    (b) detecting a methylation level of C1orf114 at two or more of the CpG sites by measuring an amplification product resulting from hybridization between the one or more nucleic acid molecules and the single-stranded nucleic acid molecules.

2. The method of claim 1, wherein said method further comprises detecting a methylation level of HAPLN3 or AOX1.

3. The method of claim 1, wherein said method further comprises detecting a methylation level of HAPLN3 and AOX1.

4. The method of claim 1, wherein said method further comprises, prior to step (a), obtaining the sample from the patient.

5. The method of claim 1, wherein the agent is sodium bisulfite.

6. The method of claim 5, wherein at least two of the CpG sites of C1orf114 are methylated.

7. The method of claim 6, wherein three of the CpG sites of C1orf114 are methylated.

8. The method of claim 6, wherein more than three of the CpG sites of C1orf114 are methylated.

9. The method of claim 8, wherein more than four of the CpG sites of C1orf114 are methylated.

10. The method of claim 9, wherein all of the CpG sites of C1orf114 are methylated.

11. The method of claim 6, wherein said method further comprises administering an adjuvant therapy to said patient.

12. The method of claim 11, wherein said adjuvant therapy is selected from the group consisting of radiation therapy, chemotherapy, immunotherapy, hormone therapy, and targeted therapy.

13. The method of claim 1, wherein the sample is a prostate tissue sample.

14. The method of claim 1, wherein said patient has a prostate specific antigen (PSA) level that is greater than a PSA level of a healthy patient.

15. The method of claim 14, wherein the PSA level of a healthy patient is about 3 ng or less per ml serum.

16. The method of claim 1, wherein the detecting step (b) comprises performing PCR or sequencing analysis.

17. The method of claim 1, wherein the patient is a human.

18. The method of claim 1, wherein the method further comprises determining the methylation level of GAS6, ST6GALNAC3, or ZNF660.

19. The method of claim 1, wherein the methylation level of C1orf114 is detected at three to six CpG sites.

20. The method of claim 19, wherein the methylation level of C1orf114 is detected at six CpG sites.

21. The method of claim 1, wherein the single-stranded nucleic acid molecules that specifically hybridize with the nucleotides of C1orf114 are selected from the group consisting of SEQ ID NOs: 45-49.

* * * * *

UNITED STATES PATENT AND TRADEMARK OFFICE
CERTIFICATE OF CORRECTION

PATENT NO. : 10,106,854 B2
APPLICATION NO. : 14/407541
DATED : October 23, 2018
INVENTOR(S) : Torben Falck Ørntoft et al.

It is certified that error appears in the above-identified patent and that said Letters Patent is hereby corrected as shown below:

In the Claims

Column 129, Lines 51-52, in Claim 1, replace "singe-stranded" with --single-stranded--.

Column 131, Line 14, in Claim 19, replace "C1 orf114" with --C1orf114--.

Signed and Sealed this
Fifteenth Day of January, 2019

Andrei Iancu
*Director of the United States Patent and Trademark Office*